United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 14

SEQ ID NO: 80069 - DNA, 201 bp, Homo sapiens; identical to SEQ ID NO: 58014

SEQ ID NO: 80070 - DNA, 201 bp, Homo sapiens
gcttacaccgcgggcaaccagtatcgcggcccctcggccgaccggcgaccacagcagtggctgcgacggcgtggagcgtacccgagcgatgtcccaggagmtactgggtaacacaccaccccacccgcttcccggctgccccggcccggccgcggggcacggcgggaaggaaaaagaggcagggacaacagggagagaaac

SEQ ID NO: 80071 - DNA, 201 bp, Homo sapiens; identical to SEQ ID NO: 58015

SEQ ID NO: 80072 - DNA, 201 bp, Homo sapiens; identical to SEQ ID NO: 58016

SEQ ID NO: 80073 - DNA, 201 bp, Homo sapiens
ccacctcagcctcctgagtggctgggactagaggcgcatgccattactcccagctaatttgttttgttttgtttgagacaagctctggctctatcacccargctggagtgcagtggtacagtatcagctggctgcaacctctgcctcccaggctcaaacgattctcccatctcagcttcctgagcatctgggactgcaggc

SEQ ID NO: 80074 - DNA, 201 bp, Homo sapiens; identical to SEQ ID NO: 58017

SEQ ID NO: 80075 - DNA, 201 bp, Homo sapiens
agtggcaggggacttgctacttccgggtcggcggcgtctggcgtggagagtttggggatctacagcagccaaaggcttgtccctgactttatatggctgckcctggcgagcgactgagtcgtccgtgaggaaaaagaggcgaggcttttccgagatcgtctcagcgatggcgcttcggtcgcagttttgggggttctcggt

SEQ ID NO: 80076 - DNA, 201 bp, Homo sapiens; identical to SEQ ID NO: 57941

SEQ ID NO: 80077 - DNA, 201 bp, Homo sapiens; identical to SEQ ID NO: 57944

SEQ ID NO: 80078 - DNA, 201 bp, Homo sapiens
cattaatatttttcttttctgtgaacagtctgtttggataatgctttgcctattaagttatgaaggggtgggttgcccctcctcacctgtgggtgtttctygttaggtggaacgagagacttggaaaagaaaaagacacaaagtatagagaaagaaataaggggacccagggaaccagcgttcagcatatggaggatcccg

SEQ ID NO: 80079 - DNA, 201 bp, Homo sapiens
ttgcatcgaattgtcttgtccatgcattttgttagtgagattgagcatatttttgtgaatttgagtcattaatatttttcttttctgtgaacagtctgttyggataatgctttgcctattaagttatgaaggggtgggttgcccctcctcacctgtgggtgtttcttgttaggtggaacgagagacttggaaaagaaaaag

SEQ ID NO: 80080 - DNA, 201 bp, Homo sapiens
ccattttacaggatcaaagaaattgaggtttagggagacatgattagtaagtgccagagctaagatttacatatgttttaactgacctcagagccaggacrctaggttattaccactatactacagcatgtaagtgtttatcaggtttatctgctgcttatctgcttggtgaggattttttagaatttcttaaggacttct

SEQ ID NO: 80081 - DNA, 201 bp, Homo sapiens
tcttcatggtagttaagagcattgactctggagccagacactgggacttaaaccatggctccattacttactagttttaatctttttcaagttacttaacstttctgtgttagtttctgcagctaaaaaaaaatatagaaaaaataatagaattgagacataagctttatctataaaccgttaagacaggcctggcatata

SEQ ID NO: 80082 - DNA, 201 bp, Homo sapiens
ggcggcgtctggcgtggagagtttggggatctacagcagccaaaggcttgtccctgactttatatggctgcgcctggcgagcgactgagtcgtccgtgagraaaaagaggcgaggcttttccgagatcgtctcagcgatggcgcttcggtcgcagttttgggggttctcggtttgcaggaaccctggtaattagtcttgcc

SEQ ID NO: 80083 - DNA, 201 bp, Homo sapiens; identical to SEQ ID NO: 57950

SEQ ID NO: 80084 - DNA, 201 bp, Homo sapiens; identical to SEQ ID NO: 57953

SEQ ID NO: 80085 - DNA, 201 bp, Homo sapiens; identical to SEQ ID NO: 57954

SEQ ID NO: 80086 - DNA, 201 bp, Homo sapiens; identical to SEQ ID NO: 57956

SEQ ID NO: 80087 - DNA, 201 bp, Homo sapiens
ttttcttcttgctcaatcttctgggcattcagaatatgtaacttatttctgacacagcacaaatgacccacttatggcttcaactttctgaaagtcggtcrtttttagaaaaatgatcattctttagccagtctacctaccactgaagtagttccatctccaacttctttgtcttgcagatcagccagctcacaaagaact

SEQ ID NO: 80088 - DNA, 201 bp, Homo sapiens
tttcactctgtcacccaggctggagtgcagggcattatcacggctcactgcagccacaacctcctgggctcaaacaatcttcccacctcagcctcccaagyagctgggactacaggtgcacaccatcacgcctggctgattttttctattttttgtagagacagagtgtcactgtgttgcctgggctggtcttgaactcct

SEQ ID NO: 80089 - DNA, 201 bp, Homo sapiens
ggatcttccgtattctctcctgtgtctgttcctccactcactctgccctctgcggattccagcttgtctttgatgtctctctggaagcagtacctttcccrccagccttgctctgtaccttaagtgctcctttccccatttccattgtctccagtgtgcacctatattaataaaagcgcctgacacagtgtggtgtaatga

SEQ ID NO: 80090 - DNA, 201 bp, Homo sapiens
agtgaaattcaggttgcttttccttggcattcattccctctacggtcattcttccaggattgtctgtgttttccgctattgaaggagaggcaaacaagtaygtatcaagagcttctgcaaacataggtgcttcccacctatgttccacagctgccaccttcaaattctgcctcaggtgccccgatcacttttgccctggat

SEQ ID NO: 80091 - DNA, 201 bp, Homo sapiens
agacagggtttcaccatgttggtcaggctggtctcgaattcctgacctcaagtgatccacctgcctaggtctcccaaagtgttgggattacaggcataagscaccgcacctggcctgaagtcttttttttttttaactttgcatatggttttctttgaggggggaggaatagacattttaaatgagttaaatatataaatc

SEQ ID NO: 80092 - DNA, 201 bp, Homo sapiens
cttcatgatacttgaactatttagtttgttattattgaggatattctcataaaggcggaggaaaaatacttttcccaagcaaaatccaagttaaatatgtdaaattaaccaaacactggattgttgaaaaatatttagtcatttattcacctcaattaatgtaactttaggatacagattcttctgtgattttattatctt

SEQ ID NO: 80093 - DNA, 201 bp, Homo sapiens
tagcctcaggcaatccacctgcctcggcctcccaaagtgctggggttataggcatgagccaccgcacccggcctgggaatgtcttacaagtgatctagackaactggcttatacagcccgtctcctttcccctttctacctgtcctcgtgaaatcaggcacagaggatccctctgacttgtctccttgttctgtttgttgt

SEQ ID NO: 80094 - DNA, 201 bp, Homo sapiens
aaagagcccaccctgaagccagccctgggagccagagttttttaaatggttgtggctttttctctgtatgtttgttttattataggtatatagcccattcktgtaacttctatctcttccctacaacgtttgggattttggactcagaattctccttccaggcttccagtgttcagtttttgaatcagtatggcttcaact

SEQ ID NO: 80095 - DNA, 201 bp, Homo sapiens; identical to SEQ ID NO: 58023

SEQ ID NO: 80096 - DNA, 201 bp, Homo sapiens
ggatgcctccccaccccccatgagcagttgagggtgccagcctgcacgccctaacctggcatccctgggcagcttgtggaggggctgtctctgtggtataygctggccctgaaggcaggctctctgcctttttcatttagcacccccagtgccaatcatagctcctgaaacacagcagacactcgggcacactcagattct

SEQ ID NO: 80097 - DNA, 201 bp, Homo sapiens; identical to SEQ ID NO: 58025

SEQ ID NO: 80098 - DNA, 201 bp, Homo sapiens
gtcagcctcctgagtaaactgggactacaggctcaccaccacacctagctaatttttaaattttttgttcagatgggttttcgtcatgttgcccaggctgktcttgacttcctgggctcgagcaatctttctgcctctgcctctcaaagtgatggaattataagcgtgagcaaccacacctggcctgtgatttttttttct

SEQ ID NO: 80099 - DNA, 201 bp, Homo sapiens
gtgctgctgacttaatcttttccttttttttctgattttcaaaaccagatgaaacgactacaaagtgccatgacagaaggtggtgtggttctacgggaacytcagagaatctatgaataaatggaagcattaattgttttgaacatgtaaatataaatctgtcagccactacagccatcaaaagagagcatctggaagaac

SEQ ID NO: 80100 - DNA, 201 bp, Homo sapiens
gtcatatttaaatatgcataccttgagattataaaaaaatttctcatgttttcttctagtactgttatgatttcagtttttgcatttaaatttttgttccrtcttatatttattttggtgctagctataaataaaagcaaagagtaagtatatccatgtcatgcatatgttcagtaacttagctctgtctcttcaaatctc

SEQ ID NO: 80101 - DNA, 201 bp, Homo sapiens
cttggcaacatagggagaccctgtctctacaaaataaaaattatcttggtgcagtggcatgcacctgtaatgccaactacttgggagactaaggcaggagrgttgcttgagcctaggggtttgaggctacagtgagctgtggttgcactgctgtactccgagctgggtgacagtgagaccctgtttctgaaaaataataaa

SEQ ID NO: 80102 - DNA, 201 bp, Homo sapiens
ctgcctcagccttccaaagtgctgggattacaagcttgagtcacatgcccagcctaaaatattttttgtttcattgcttttcttttgacttcattttactktttttttttttttttttttaaccatgcagcaaattttgtccatcatttcttttttatgccatatgaggggctgggcatggtggctcagcctgtaacccca

SEQ ID NO: 80103 - DNA, 201 bp, Homo sapiens
ggcctgcgtgcccctcgacgtgagcgatgattggcggtgcaggataacagatcgccttcttggccactcagtggcaggggacttgctacttccgggtcggyggcgtctggcgtggagagtttggggatctacagcagccaaaggcttgtccctgactttatatggctgcgcctggcgagcgactgagtcgtccgtgaggaa

SEQ ID NO: 80104 - DNA, 201 bp, Homo sapiens
cctcctgcctcagccttccaaagtgctgggattacaagcttgagtcacatgcccagcctaaaatattttttgtttcattgcttttcttttgacttcatttyactttttttttttttttttttttaaccatgcagcaaattttgtccatcatttcttttttatgccatatgaggggctgggcatggtggctcagcctgtaac

SEQ ID NO: 80105 - DNA, 201 bp, Homo sapiens
tggtcttgggcgtagctacgaggtggttggtgggctccagggcctgcgtgcccctcgacgtgagcgatgattggcggtgcaggataacagatcgccttctyggccactcagtggcaggggacttgctacttccgggtcggcggcgtctggcgtggagagtttggggatctacagcagccaaaggcttgtccctgactttat

SEQ ID NO: 80106 - DNA, 201 bp, Homo sapiens
cccggacttaagcaacaagcgtggtcttgggcgtagctacgaggtggttggtgggctccagggcctgcgtgcccctcgacgtgagcgatgattggcggtgmaggataacagatcgccttcttggccactcagtggcaggggacttgctacttccgggtcggcggcgtctggcgtggagagtttggggatctacagcagcca

SEQ ID NO: 80107 - DNA, 201 bp, Homo sapiens
gctgggaagttagcaagaacaaatcaatttatttctgtcttttggaaggtgaaagtattttcagcctactcgtgctgctgacttaatcttttccttttttwtctgattttcaaaaccagatgaaacgactacaaagtgccatgacagaaggtggtgtggttctacgggaacctcagagaatctatgaataaatggaagcat

SEQ ID NO: 80108 - DNA, 201 bp, Homo sapiens
ttaagatcactttctgaaaaactgttgtaggctgggaagttagcaagaacaaatcaatttatttctgtcttttggaaggtgaaagtattttcagcctactygtgctgctgacttaatcttttccttttttttctgattttcaaaaccagatgaaacgactacaaagtgccatgacagaaggtggtgtggttctacgggaac

SEQ ID NO: 80109 - DNA, 201 bp, Homo sapiens
ctgggccccagcagatcaggtaaaactaaagctgtgtcccctctgtataagagcctggccagaccagcactgtttctggccagcagcctgttggcatttgsggggcaggacgttttgtgtggcttgctcctacgtgttggaggaccttgcttttttctgtccactaaatgatggtagtgctccctagttgttgtaacaagg

SEQ ID NO: 80110 - DNA, 201 bp, Homo sapiens
gtgctggcacagagatgcttagaggcgggaatcaacttcatggtctaccaaccaaccccgtgggaggcagcctcagactcggtatttttgttttcatgtayttattgaaaaggtattgtgttaattcttggcattggataacttacataataataacagtttttacttaccaaatactttccatgtgtcagaccctttggt

SEQ ID NO: 80111 - DNA, 201 bp, Homo sapiens
ccctctgctgcaggagctcgtccaggaggccgacttcgtgggtgaagagcctgggattcgcggctgtgccggacagagccccttgccccgggcgagcttgrggagggggtggcgggacggttgccaggccacagggcctcagagagggcctcgggaaggacaggggggcttccttctccagccccggggcggtgggacttt

SEQ ID NO: 80112 - DNA, 201 bp, Homo sapiens
gtggagcacatatgaggttgatgtaaagcacttattactgtgtctagttcatggcgagtgatctcagtgaatgacagttgtttgctgctcggagtgtgggktgttttttaaaataggaaatgtcagtatcaatctaatattatagaacagtcagtatgtgaaaatgaaaggaccaaatgccaacctcacttggactcttgg

SEQ ID NO: 80113 - DNA, 201 bp, Homo sapiens
tatgtggaagttcattttactattcttgcaacttttgtataagtctgaaattattttagtatttaaaagtttaaaaaaaaaaaggccctcctgtggctgargtggtaggagggttagtgtgaaaagatgggagaggggctatgggatggagaggggtggggcagaaccctggaaggtgaccccctgggagtggatggctga

SEQ ID NO: 80114 - DNA, 201 bp, Homo sapiens
tttgtggaagggacaattccagggtgggaaaaagatatttatgggccacattttttatatcttcaatttactttttattatcttgaggaagtaatagatcrttgaaaatgtgaatttttttacttctcctgttgagagacaatatgaagttaataagaacaagattactttacaaaacattctgggcttggcaggttcagc

SEQ ID NO: 80115 - DNA, 201 bp, Homo sapiens
catatagagagagagataaagtaagtgtagttaaatgttaacatttggggtatgtaggtgagtggtatgtggaagttcattttactattcttgcaactttwgtataagtctgaaattattttagtatttaaaagtttaaaaaaaaaaaggccctcctgtggctgaggtggtaggagggttagtgtgaaaagatgggagagg

SEQ ID NO: 80116 - DNA, 201 bp, Homo sapiens
cctaatcatacacaggttcctccttttttctttctcacagcacccttggcacttatctgaaacatagctttgtatttttttgtacacacagctgccggctrgctatccctccaagagcaaatactgtgtctgttctcttcacccatttataaaatggtcatcatggtgcctcactcatcattagcttttactaaagggtgg

SEQ ID NO: 80117 - DNA, 201 bp, Homo sapiens
tgggttcaagcgattctcctgcctcagcctcccgagtagctgggactacaggcgcctgccaccacgcctggctaatttttttgtatttttagtagagacgrgatttcactgtgttagccaggatggtcttgatgttctgacctcaggtgatctgcctgcgtcggcctcccaaagtgctgggatcataggtgtgagccactg

SEQ ID NO: 80118 - DNA, 201 bp, Homo sapiens
gttcaagaccagcctaggcaacaaagcgagacctcatgtctatatttaaaaataaataagtaaataaatagagggcattatcaggacagctggcagcattygaataaagtctgtggattgagtgatagtattctaccagcggtagttttctgttctttgttccttctcctctaccactgctccacttgactagccttaaaa

SEQ ID NO: 80119 - DNA, 201 bp, Homo sapiens
gttagttgtaactccgctgactgaccacctttgctgtgcttgatatttatgtagagcactcaggctaaaatgcccatggcttccctgtccttttattctcrtgggtgatggcgagtagagcacagagggccaagtgacttgtccaatctgcgtagacagtaacagttccccatccatggctctttccacagctgaggagcc

SEQ ID NO: 80120 - DNA, 201 bp, Homo sapiens
atttgaatgaattgtatcgatacctgggagaagccaaaggttgctttgttagttgtaactccgctgactgaccacctttgctgtgcttgatatttatgtaragcactcaggctaaaatgcccatggcttccctgtccttttattctcgtgggtgatggcgagtagagcacagagggccaagtgacttgtccaatctgcgta

SEQ ID NO: 80121 - DNA, 201 bp, Homo sapiens
taagttcttattttttcatttgaatgaattgtatcgatacctgggagaagccaaaggttgctttgttagttgtaactccgctgactgaccacctttgctgkgcttgatatttatgtagagcactcaggctaaaatgcccatggcttccctgtccttttattctcgtgggtgatggcgagtagagcacagagggccaagtga

SEQ ID NO: 80122 - DNA, 201 bp, Homo sapiens
atctaactgggtaatcactcaataaaattaagttcttattttttcatttgaatgaattgtatcgatacctgggagaagccaaaggttgctttgttagttgkaactccgctgactgaccacctttgctgtgcttgatatttatgtagagcactcaggctaaaatgcccatggcttccctgtccttttattctcgtgggtgat

SEQ ID NO: 80123 - DNA, 201 bp, Homo sapiens
ggtgtggtggcaggtgcctgtaatcccagctactcggaaggctgaggcaggagaatcgcttgcagctggaaggcagaggttgcagtgagctgagattttgycactgcactccagcctgggcaacaagagtgaaactccatctcaaaaaaaaaaaaaaaagaagtttattttatttcctcattggatgtgaccaacttccta

SEQ ID NO: 80124 - DNA, 201 bp, Homo sapiens
ctagtcttgaaagccttggaagtaatgtcaggtcctcgccaaaatcatccctgtgtctccaaagcacatgtatcgccagggctgttcctcagcctcctccyctcacagagctatagctgctcactctttcttgtattttccccctaggtgccctggcctccaagagcaagaagccatgtgttcagtacctgccccccgaga

SEQ ID NO: 80125 - DNA, 201 bp, Homo sapiens
gtgtttcttgctaaaagttgtatagttttgtgttttacattgaagtcttaagtcttacatttaagatccattttgagttacttttcatataaggtgtaatrtttaggttgaggttgatttttttccccctcctgtagatgtccacttgctgtagcacactttgttgaaaggactacctctcaccattgaattgtttttaca

SEQ ID NO: 80126 - DNA, 201 bp, Homo sapiens
cagccagagctcctcatggaagctcgcttgtttatgtggcccagctccagagagggttgtcctgtctatctctgcttgtgggttttctggggaggctgcaytggagagagaggatgtgtctcagcctgacacaccacactctgctgaggttgtggcagtccctggcttggggttaggacatcttaggaagtggcagctcac

SEQ ID NO: 80127 - DNA, 201 bp, Homo sapiens
agttgatggatttttaggtacccatctatcctgtttaatattagggggtatagatttgggatacttctctttagcacctggtagttgttattgtagtttawtttttaaaaccagaaatgttcaagttgttgcttctagaaaaacgagtgtggtgtttaggcttcaagtgcaagctctgggcaccttcagcatccctccagg

SEQ ID NO: 80128 - DNA, 201 bp, Homo sapiens
gccaggctggtttcgaactcctgacctcaagtgatctacctgccttggcctcccaaagtgttgggattacaggcgtgagccgctgcacccagcctccataytctttattctagctgctcaagcagttttctccacacctgtgcttctttaaaacagtggacttgatggaaaaattgaatgttaccactttagttggatcct

SEQ ID NO: 80129 - DNA, 201 bp, Homo sapiens
aaagttccaagtgaaggtacctgttagctggggctattaactccctcttgttgggctcctgtaccctgtctgcaggggctagggccagtggccatgatgaraaatgagcacacgtggctcaagaacagagcctgtgatttgcccattggtactgagtccaccttggtgggaagtcagtggcaattcttccacccacacacc

SEQ ID NO: 80130 - DNA, 201 bp, Homo sapiens
gtatgagggggattcaattcaacccataacaaatatcttccaagccggccactttgactgcagcctttaacgggtagctgcatatttttttttctttacayccactctcaccctcaaattgctcaaaacaccggagcccagggctggttgcctgtcagcgttcagcacgaacctgcccactgactggcgtctgctccctgg

SEQ ID NO: 80131 - DNA, 201 bp, Homo sapiens
cctcagtcacaaccaccaagctccgtccactgcacctgcccacgtcctgtgtgctctgcacatccctgattccctaatcatacacaggttcctcctttttyctttctcacagcacccttggcacttatctgaaacatagctttgtatttttttgtacacacagctgccggctagctatccctccaagagcaaatactgtgt

SEQ ID NO: 80132 - DNA, 201 bp, Homo sapiens
ctacataaaattaatatttttcatgcttatattttactctttcaacaaaaaataagcatatatatatttctaccaactgatacatttcaagagataagggycacaaggagattttcactcaagttgcacgtggaatgtttacctgtttttgaaagggcatgctcagataatgacagcagatttgaacaatgcttcgtttcc

SEQ ID NO: 80133 - DNA, 201 bp, Homo sapiens
ttcctccgagtgggacagacgaatgttacatatccagttcaggtagcaggcaagctgtttccgattgccaggaaggcccttagaaccagctggccttcgttaagttaggctagagagcgaataaggcagtatatctctaagcagtagcccaaagaggaaagtgattgctgtctccaatggagggatcacaaaggtgtggag

SEQ ID NO: 80134 - DNA, 201 bp, Homo sapiens
tctccgagaaagggaatgcagattttattcaaaagggaagaaaaggcactaacaaagtatgagcaagtttgggccctgcctgcccagcctttccttccccrtggctccgggcagcttttttccccccatcccccaccctgcattacttgactggtgaggaaataatagttgggctctgctgagaaggtatgtgactgtgca

SEQ ID NO: 80135 - DNA, 201 bp, Homo sapiens
cagatcacgaggtcgagagatcgagaccatcctggccaacatggtgaaaccccgtctctactaaaaatacaaaaattagctgggcatggtggcgggtgcaygtagtcccagctactcgggaggctgaggccagagaattgcttgaacctgggaggcggaggttgcagtgagtcgagactgcactccagcctggtgacagag

SEQ ID NO: 80136 - DNA, 201 bp, Homo sapiens
ccacagacccctgcttcagaatcatcacaggtgcttgtcgaaatgcagactcctgggcccattccaaagcgcagaaggtgcagcactggaattaaggggctgtctcccaggggtgacaggcacatacacccaggcaatggggagcgacacctttgcacagaaacccaccgaggcagctattgcatttcctgattatgaggt

SEQ ID NO: 80137 - DNA, 201 bp, Homo sapiens
attccagcactttgggaggccaagatggaaggatcacttaaggccaggagttcaagaccagcctgagcaacatagcaagaccctgtctctacaaaaaaaawttttaaattagccaggcgtggtggtgtgtgcctgtagtcacagctactcaggaggctgaggtgggaggatcacttgagcccaggaggtcgaggctgcagt

SEQ ID NO: 80138 - DNA, 201 bp, Homo sapiens
gcctttccccttgcctcctctgagaggcctcgctcctgcctggccccttccccacacacatgggcatccccatcttcattctaccttctgccctgctgggkaggctgagggcccagcacagctatggcccctggctggagccctgtagtttctccccttggcaggcatctccactagtgccatagggttggtgctaggtag

SEQ ID NO: 80139 - DNA, 201 bp, Homo sapiens
gtcatgatttcaagactagcttggccaccatggtgaaaccccgtctctactaaaaatacaaaaaattagctgggtgtggtagcacacacctataatcccarctactcgggaggctgaggcgggagaattgcttggacccgggaggcagaggctgcagtgagccaagactgggcaaaaaagcgagactttgtttcaaaaaaa

SEQ ID NO: 80140 - DNA, 201 bp, Homo sapiens
ctctgagaggcctcgctcctgcctggccccttccccacacacatgggcatccccatcttcattctaccttctgccctgctggggaggctgagggcccagcrcagctatggcccctggctggagccctgtagtttctccccttggcaggcatctccactagtgccatagggttggtgctaggtagacaagtgtgaagggcta

SEQ ID NO: 80141 - DNA, 201 bp, Homo sapiens
ataataacatggtcatttccggagtacttgccatgtgccaggcatcattctaaacatgtatgttaactaatttaatcctcacaacagccctgtgaggtggygatttcggtcagcatcatctcattacctccacatgcagggagggaaaatgaagtgtggagaatcgcagcaacctgcctaagggtcacatagctaacaagt

SEQ ID NO: 80142 - DNA, 201 bp, Homo sapiens
tgttcatcccttctataaatcttgtaaataaagttaatacttgcatgtcactgatgaattcacttccaagttactgcctgtgacctaccatgcacacaaarcagtggttgctggcaggtgtggcctgacccttgttgtctttcacaccactttgtccctcagtcacaaccaccaagctccgtccactgcacctgcccacgt

SEQ ID NO: 80143 - DNA, 201 bp, Homo sapiens
ggtgatctcagtatgtctcttagccattttgcatttaagattctctgtctataaaatggcaatctgctgatcttaaaaaaaatgtggaagagacaataaartaaaatcccagttctactgagttctaacagccagaaaccgtgagccatttaaaattttgtttgtctcatgtttatgagaaaggataaaataacagatatc

SEQ ID NO: 80144 - DNA, 201 bp, Homo sapiens
cttgcgctgagctctgcctctgtgccctgcgcgccctgcacagtggagccccctcagaggcaagcccaggactaggcctccctgcccccgcccaggcagcrtgctcccagcattaccttcccgcttccttcccatatttctcatcccttcttcccaagtgcctctcttcctctgccctgagctttcccaatatgctgacca

SEQ ID NO: 80145 - DNA, 201 bp, Homo sapiens
tatagttttcccagactgtgaggctccacccaggctttctgtctctgccagtgccaagatgctgcctgtcctaccacctgtgctgagagggtgtccctaaygtccatgatggttcaggctggagtaactagaaaaagaactcagtttccttcccaaggaagaaactgtaattcagtccctgcccagctcacaatggtgatc

SEQ ID NO: 80146 - DNA, 201 bp, Homo sapiens
gcaaccagcagtgtgtgccatatcacagtaaacactccaggagtgggttctcacagaagaatcaggaggaaacccctggcatgagattcagagcagaatcyccctcaagttcttggatggtggcagcagctgctgtggagtctctgttgcaagcttttagttcgcaggcacactggttcaagtttaatcaccacaaaaata

SEQ ID NO: 80147 - DNA, 201 bp, Homo sapiens
aatgtaagtgtcagttttgcagtgaaaactggatgtgggtctatggctgttgctttttctcattaaaagaaaagaggtgcgtgccaatcaaagggggggggatcaacgagctgctgcggtcttatttaggttttcagtgattcccaccagtgcccacacatgtagcttagttctgcaagttttgttgggattcgtgtaact

SEQ ID NO: 80148 - DNA, 201 bp, Homo sapiens
ttaacatttggggtatgtaggtgagtggtatgtggaagttcattttactattcttgcaacttttgtataagtctgaaattattttagtatttaaaagtttwaaaaaaaaaaggccctcctgtggctgaggtggtaggagggttagtgtgaaaagatgggagaggggctatgggatggagaggggtggggcagaaccctgga

SEQ ID NO: 80149 - DNA, 201 bp, Homo sapiens
aggctgaggcaggagaatcaggctgataatgagccaagagaagaggagaaaccaagtctgccaggagaaatatgaatttggaccttggagaatgaaaattrtaggaaaagtaggcagggtagatgggcagggaaacccaaagcatggtcagggcatcttctgaggatgatggggatcctgcaactaagccagccaaacttg

SEQ ID NO: 80150 - DNA, 201 bp, Homo sapiens
ctctaccactgctccacttgactagccttaaaaaataaaaagcaattaaaataaataagatggcaattttatgactaggtaaactggtattgtaagaaaaygtcttttttgggaaatacagaagtatttagacaaaaggggacatcatgtgtgcatcttactctaaaatggtttggggaaaaatgcatatagagagagaga

SEQ ID NO: 80151 - DNA, 201 bp, Homo sapiens
tcactgacttaagctgttctgttgttatatacacccacgtatgagtggtaagtgctgcaggcattttaaggtaggaaaggttattattcccatttatggaygcaatacctgaggctcagaaatattaagtggcttcccaaggtgagtggcagagcttcagtggaaacgggggcttaggctcttagcaactgaggcgagggc

SEQ ID NO: 80152 - DNA, 201 bp, Homo sapiens
gaaatatgtccttgatgttgccaccagaaggccctgattgcagccacgtgtccaccaggggagccccgcagtgcttcccacctcacatcccactcagccaygtccagcttggtataccaacaagcatcagacaatgatgttagggccatggggtgccattgaggtaatggtcggccctcctctcccttggagagaaggcag

SEQ ID NO: 80153 - DNA, 201 bp, Homo sapiens
tggtatcagagctggggctggcaggggagaggcagtgttcgggaaagtggagtccgcctgaagattgtgggaccttccgtggggaaggtaacccggaagcrgtttcagattgggtattggaggagaatgagcggacaaggagcaaatttaagagccagctttcaggaaataggtctatagtccttggtggttctggtgtct

SEQ ID NO: 80154 - DNA, 201 bp, Homo sapiens
tgaatatgttgattggttgtgctggaatggatcggttctctccaccacttaaagttcagcttagttgtcattcgtgtccccccccccaaaatgacataggrcgtggtgaggctggtagtgattgtaaatatatgctcgctcctgttataatcgtttggaaattgacccagtacagggcatgtggcatgaaaatgcaggcca

SEQ ID NO: 80155 - DNA, 201 bp, Homo sapiens
ggagaggacgctgcagtcagcagatgggcagtgaggcggggaagaaaggcggaaccaggcctggtatcagagctggggctggcaggggagaggcagtgttygggaaagtggagtccgcctgaagattgtgggaccttccgtggggaaggtaacccggaagcagtttcagattgggtattggaggagaatgagcggacaagg

SEQ ID NO: 80156 - DNA, 201 bp, Homo sapiens
ggagcatgcaggtggaaggccagattcctcacctggagagctccgcagaagatgatctcatcaacctacccttttcttggcccatcttcatggtgtgtaargacaaggctgcagcacttggaccctctctcaggggatgctgctgtgcttagactgaggtggccctgctgatgttccctgcccttggtataggggcgggac

SEQ ID NO: 80157 - DNA, 201 bp, Homo sapiens
atgtgggttagaaatctggaagggcattttccatggagcgagcctttagccaagctctaaaggccaggtaggatttgggtgagcaggaggagaggacgctscagtcagcagatgggcagtgaggcggggaagaaaggcggaaccaggcctggtatcagagctggggctggcaggggagaggcagtgttcgggaaagtggag

SEQ ID NO: 80158 - DNA, 201 bp, Homo sapiens
agcagtggttcccaaattttcttggtctgtgaagacgtattttctctatttttagccaaacagaatgattttagtccatcatgggtcaaaccttctgatawtctttagtccccatggaagacattcttgtttctcctttaagaccatctctggggtcaccttcggttgccttgggggtgtttgagcctctgccgcagggac

SEQ ID NO: 80159 - DNA, 201 bp, Homo sapiens
tccatgtgggttagaaatctggaagggcattttccatggagcgagcctttagccaagctctaaaggccaggtaggatttgggtgagcaggaggagaggacrctgcagtcagcagatgggcagtgaggcggggaagaaaggcggaaccaggcctggtatcagagctggggctggcaggggagaggcagtgttcgggaaagtg

SEQ ID NO: 80160 - DNA, 201 bp, Homo sapiens
cttcactcgagcagtggttcccaaattttcttggtctgtgaagacgtattttctctatttttagccaaacagaatgattttagtccatcatgggtcaaacyttctgatattctttagtccccatggaagacattcttgtttctcctttaagaccatctctggggtcaccttcggttgccttgggggtgtttgagcctctgc

SEQ ID NO: 80161 - DNA, 201 bp, Homo sapiens
tgagacggagtctgtctctgttgcctaggctggagtgcaatggcgcgatctcggctcactgcaacctctgcctcttgggtttaagcgattctcctgcctcrgcctcctgagtagctaggattacagacccgcaccaccacgcctggctaatttttgtatttttagtagagacaaggtttcaccatgttggtcaggctggtc

SEQ ID NO: 80162 - DNA, 201 bp, Homo sapiens
ggataacacaagatattcattttcctcaaactttcccgcacaggttggagagaaacgacatcttaatgtcattgtaacaggcatttctttattaaaaaaawtttttttttggagacaaggtcttgctatgttgcccaggctggtctcaaactcctgggctccagcgatcctcctgcctaggcctcgggagtagatggaact

SEQ ID NO: 80163 - DNA, 201 bp, Homo sapiens
tataccaacaagcatcagacaatgatgttagggccatggggtgccattgaggtaatggtcggccctcctctcccttggagagaaggcagaattcttcccastgagctgacctccccgtggcccctgtggccaccacccccacaccaactttgtttgatccatacttcttattcccaaactcacttggcacactcttgtcac

SEQ ID NO: 80164 - DNA, 201 bp, Homo sapiens
ttttgagataattgtgaaagatccaaattgaaaaagaagagccaacaatactttcttgttactaaaagttgatatcgcataaacctgcgttctgcaaactkggatctagagcatgacaagatagccttgaaagatgaatatttcagagagaggaggatgagatcccaagggccagcagtgtgctcactctctggaatagct

SEQ ID NO: 80165 - DNA, 201 bp, Homo sapiens; identical to SEQ ID NO: 5507

SEQ ID NO: 80166 - DNA, 201 bp, Homo sapiens
attttgagataattgtgaaagatccaaattgaaaaagaagagccaacaatactttcttgttactaaaagttgatatcgcataaacctgcgttctgcaaacktggatctagagcatgacaagatagccttgaaagatgaatatttcagagagaggaggatgagatcccaagggccagcagtgtgctcactctctggaatagc

SEQ ID NO: 80167 - DNA, 201 bp, Homo sapiens
caggtcagccttccttctcatcagtccttcattcagcagtctctgaaccttccccactgaacacacctagtgcgcttctacctccttccagactctacccmctagcatgctggcctaacaacattggctttgatgacctgaactccagattcgcctgctgtccacagtttctttctttctttttttttttttaatgagatg

SEQ ID NO: 80168 - DNA, 201 bp, Homo sapiens
cgaggctgcagtgagccaagatcccaccactgtactccagcttgggcaacagaacaagaccctatttcaaaaaaataaacaaggagaaggaaatcctgccrtttgtgacaacaaatggatggacctggaggacatcatgctaagtgaaataagctagtcacaggacaaatattgtatgattctgcttgtatgtgggatcga

SEQ ID NO: 80169 - DNA, 201 bp, Homo sapiens
agcctggccaacacagtgagaccccgtgtctaagaaaaatacaaaaataagctgagcatggtggcacatgcccgtagtttcggctactcgggagactgagrtgggaggatcgcttgagcccaggaggtcgaggctgcagtgagccaagatcccaccactgtactccagcttgggcaacagaacaagaccctatttcaaaaa

SEQ ID NO: 80170 - DNA, 201 bp, Homo sapiens
attaattaaaaattaaagaattatatgattcagcaatctcattactgggtatatatccaaaaaaattgtgaaatcactgtcaaagagacgatctgtacccscacattcactgcagcactattcacaatagccaagttacagaaacaacctgagtatccgtcgacagatggatggctaaaggaaatgtgggctctgcacgca

SEQ ID NO: 80171 - DNA, 201 bp, Homo sapiens
ctggtgcgtgtatttttttcttttttcagacggagtcttgctctgtcgcccaggctggagtgcactgacgtgatctcggctcactgcaagctctgcctccygggttcacgccattctcccgcctcagcctcccgagtagctgggactacaggcgccggccaccacacccggctaattttggtgcatgtatttctattttta

SEQ ID NO: 80172 - DNA, 201 bp, Homo sapiens
tctactaaaaatacaaaaaattagctgggtgtggtagcacacacctataatcccagctactcgggaggctgaggcgggagaattgcttggacccgggaggyagaggctgcagtgagccaagactgggcaaaaaagcgagactttgtttcaaaaaaaaaaaaaaaagaaatcatgacattccatactttttcctttacttcc

SEQ ID NO: 80173 - DNA, 201 bp, Homo sapiens
tggtctggtctttagagcaggcatgacctatgcccgtgggcccacatcccttgtagctgtgatttggggcaggaacagtgattttacaaagttaaaaaagkcatgtaaaaatccagactttcggccaggaatggtagctcatgcctgtaatcccagcactctgggaggccgaggcgggtgggtcacctgaggtcaggaatt

SEQ ID NO: 80174 - DNA, 201 bp, Homo sapiens
cggatgtggtggcacgcgcctgtaatcccagctactcgggatgctgaggcaggagaatcgcttgaacctgggaggcagaggttgcagtgagctgagatcaygccgctgcactccagcctgggcgacagagcaagactccatctcaaaaaaaaaaaaaaaaaaaaaaaaaattccagacttctagcctgtctcaaaaaatca

SEQ ID NO: 80175 - DNA, 201 bp, Homo sapiens
gtgcatgaatggaccccagctcctttttgggtgggagcagccatgacaaggaactgtattaaacttcgaaatgcagaactctagagtagcctgtgtctacrctgattttaagttatgaattttctagtggttcttattataggtaatgagacatattccctacaaatcaggaatatcctataattctatggtttccacctc

SEQ ID NO: 80176 - DNA, 201 bp, Homo sapiens
agatcagttggaagtttctttattttttatttagagacagagtctcactctgtcacccaggctggagtgcagtggcgcaatcacagctcactgcagcctcragctcgagggctgagtcgatcctcccagctcagcctctcgggtagctgggactacaagcgtgcgccaccacacctggctaattttttttgtatttttgta

SEQ ID NO: 80177 - DNA, 201 bp, Homo sapiens
agcccagcccctctccctcaccaccaaaccagaaacccgggcccagctggctctccactctgccgccttcctgtcggctaaggctgcagcctcctcctctrggcagatgggcagccagcctcccctcctgtcccggcccctcccccttgggtccatgcccacagctctgctggcctctcccccgtccttccccgccacgct

SEQ ID NO: 80178 - DNA, 201 bp, Homo sapiens
ttcctgaggagtgaaagatggtggctgtcagcgtgtcaaggatgacgggtggcaagaggggtaaacacagcttgttactaccagattcgattaccgggtgrtgctcgaagacaaatggcctggggcctttctgccccttgagggcaggggcagtcttagtcaccaggagcagggtcctatgaggaggagttagggatgttg

SEQ ID NO: 80179 - DNA, 201 bp, Homo sapiens
gtcacctgtgtagaatttgcacatatactcaagtgttatttgttttcaattacttcctcaattattgctggtgtgtgtgtgtgtgtgtgtgtgtgtgtgtrtgtgtgtgtgtgtgtgtggtatttcatagccaaagctataaaatgtatttccaataatattagtagaattttttcagcccctaaaacccaccataaaagt

SEQ ID NO: 80180 - DNA, 201 bp, Homo sapiens
aattcatattttatatagttaaaatcaaagcataggtacacagtttttggtggtttcttcatttcattatataatgatttccctcaaagttctaggcattrtaagatgaagacgacagaacacagatatcatgtagctgcagtaagcattgggatggctgcacaccattctgtggaacggatatagagtcatttgttaacc

SEQ ID NO: 80181 - DNA, 201 bp, Homo sapiens
ttggagttttcggaaacgatggattccaaacaacttccagtgagcaattggtgatattaagttaactgagttcatcttaccctttttattttgcctcagaragtaaaataagatagaagcaaacataccagcccacaaacatgtccatgcttccttttgcttctagaaggcgtatgttgggaaattaatcagaccaacgtt

SEQ ID NO: 80182 - DNA, 201 bp, Homo sapiens; identical to SEQ ID NO: 29766

SEQ ID NO: 80183 - DNA, 201 bp, Homo sapiens
acctgagctccccagtgtctgcaggtagatgattatttaataccctcttcccatacatcttcatggtcaggagactggaccttggcaattctgttattagrcagctccactcgtagggaatttctcccttatatttagctgttgttttctcctccattccactgtctggagtccccatggcaagttcgcatcctctttcat

SEQ ID NO: 80184 - DNA, 201 bp, Homo sapiens
accttgggaggctgagacaggcagatcacttgaggtcaggagttcgagaccagcttgaccaacatgatgaaaccccatctctactaaaaatacaaaaaatktagccgggcatggtggcacgcacctgttaatcccacccactggggaggatgaggcaggagaatcacttgaacctgggaggcagaggttgcaatgagccaa

SEQ ID NO: 80185 - DNA, 201 bp, Homo sapiens
gttgggcacttacaactttattaagagggtcaatctcatgttaagtgttcttaccaaacacacacacacacacacacacacacacacacaaagggacacawggaagcttttggaggtgatgatgtgtttattaccctgaccatggtgatggtattatggatgtatgcacgtgttcaaactcatgaaattatctatattaaa

SEQ ID NO: 80186 - DNA, 201 bp, Homo sapiens
acccacctcagcctcccaaagtgctgggattacaggcatgagccactgcacccagcctatagttttataactagatgatagtttattccataactataaayaacatttttaaaacttcagaaaagtgggaataaataatttagttttccttttaaaattaaagcttattttgaaagttattttggtgcttaaaagagagag

SEQ ID NO: 80187 - DNA, 201 bp, Homo sapiens
agcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgcctca

SEQ ID NO: 80188 - DNA, 201 bp, Homo sapiens
cagcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgcctc

SEQ ID NO: 80189 - DNA, 201 bp, Homo sapiens
acagcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgcct

SEQ ID NO: 80190 - DNA, 201 bp, Homo sapiens
gcttctttgctgctgtgccacactgtgcttctctatgtcagtgcaacttccaagttttggtggaaatctaccaccataaagtagcttcctctcccaacttyattctcttagttcccattctcctaatcacccaaacttggtgacttcagctcttctctccctcctgtcccataataaccactcactcctaggtcctatgta

SEQ ID NO: 80191 - DNA, 201 bp, Homo sapiens
cacagcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgcc

SEQ ID NO: 80192 - DNA, 201 bp, Homo sapiens
acacagcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgc

SEQ ID NO: 80193 - DNA, 201 bp, Homo sapiens
cagttctgtagcgactagaggtagaatataatatgcctattgtaattttaaaacaataagcatttatttgctctaaaaggatataccattctctctctctytttttttttttttttgagacagagtctcactctgtcaccgaggctggagtgcaggggcgcgatcttggctcactgcaaccccagcctcccaagttcaagc

SEQ ID NO: 80194 - DNA, 201 bp, Homo sapiens
ccagtttgtgtgagttcttgatcaaatagctatcaacaagataatgtgcatatatatgtgtgtatatgtgtatatatgtatatacacatatacacatatatgtgtgtatatgtgtatacacacacacactaactttataaataagttgaaatttatatgtaggatatatgtaagcagtatagtatataaatataaattaca

SEQ ID NO: 80195 - DNA, 201 bp, Homo sapiens
ctccctccttgcgctgagctctgcctctgtgccctgcgcgccctgcacagtggagccccctcagaggcaagcccaggactaggcctccctgcccccgcccrggcagcgtgctcccagcattaccttcccgcttccttcccatatttctcatcccttcttcccaagtgcctctcttcctctgccctgagctttcccaatatg

SEQ ID NO: 80196 - DNA, 201 bp, Homo sapiens
gtacatctgggcagtggcagtacctgcgtcctgatcttgttgtggggatttgctgagcttcagtctgtgtaaaagcccagaagcacctgataattattatygtggctgctgttattatcttgactcctctatgcccaaccctgggaagcattcatgtgcttgctctgtgggtcggaagaaggaaaactcatcacagcctgg

SEQ ID NO: 80197 - DNA, 201 bp, Homo sapiens
acccagtggtgagtccgtagcaggtgatcaataaatgctaaagatgctgattgtcattgtcaccactatcacgaaattgtgcagcgttcgagggaactccrgggagccacataccctcgccagtgatgtacctctacaatggcttcaacaaacagttcccacacaacgcaacttttcctacagttgggtgggctccagggt

SEQ ID NO: 80198 - DNA, 201 bp, Homo sapiens
ggggcactggcctcttctcctgcttttccttttgtcacagccacacctgcccatgctgtctctagctccctgatgggtcagggcttctgcctcggtattcrcgggcgggtattattacccctttctcgaggtggccacttaagaggctctgagatgtgaaggcattttcccaggcactctgcttcagtggtggtggtagga

SEQ ID NO: 80199 - DNA, 201 bp, Homo sapiens
aaaagctccccaggggcttctaatatgcagccaagtttgcaaaccactgctctagttgaaagctcctcactgaatatctgaatgaaaggattaaacagatmcctgcctagtgaggtattggcccccctcccccataagaccatgggctggtggtagagttgccagcagttctttcctggattccctatgcccctccatcac

SEQ ID NO: 80200 - DNA, 201 bp, Homo sapiens
gaggggagccccagtcccagagattgaggaggacaggatcttggtggtcccagctgggccaggggccccaggaccctagcattaaggtgtagcccctgtgycacttgtggatgaagctgcccttggggatccactcactggcagacgtggtggtgtctgggtgttaaatctatacaccatatgtaataatggtgggcatct

SEQ ID NO: 80201 - DNA, 201 bp, Homo sapiens
tagccaggttggtctcgatctcctgaccttgtgatccacccacctcggcctcccaaagtcctgggattacaggcgtgagccactgcacccggctagcctcyataaaatttaatctctacactgcactattcctaggacactaacttatgtttaattttggattgctagttttctagaatacatattcttaagtatgttggc

SEQ ID NO: 80202 - DNA, 201 bp, Homo sapiens
cctgtttttgaaagggcatgctcagataatgacagcagatttgaacaatgcttcgtttccttagttctcacattgctacatggatgggatatgttggtcayctatgtgattacatcatcatcaatcaggcagaagttcagtccttctgaagattcatgctaaagctggataacagatttccattgactagtataggctgaa

SEQ ID NO: 80203 - DNA, 201 bp, Homo sapiens
gtttttaaaaattgacagtgtagggcaggagcaataattttttcagttgctagattgtttctgtgacactatagaacatatttgtgcatactaaataaggwgaaagtatgagatatcttggggtctctcatttttaaaaaataacaggtttattttctctgaagcttttatagtctttattatgtctggatcaaagatgat

SEQ ID NO: 80204 - DNA, 201 bp, Homo sapiens
cctcctgagtagatggaattataggcgcctgccaccacacccagctaatttttgtatttttagtagagatggggtttcaccatgttggccaggctggtctygaactcctgacctcaggtgatccacccgccttggcctcccaaagtgctaggattacaggtgtcagccaccgcgcccagcccttaaaattttttttatagg

SEQ ID NO: 80205 - DNA, 201 bp, Homo sapiens
atgaaagtaaagttactttaacttttcccctcttgcgggttgaggttttggagtccacctctgggatcttccttggcctccagaattcttcgcctgcaccraaggaaacttggatttgtgcccgctttgggggggtctcgctttccttcttggaaatcggtcagctttctctggcagtggggcaaggggcctagggagctg

SEQ ID NO: 80206 - DNA, 201 bp, Homo sapiens
actagggtccagctgcactctacagtggtaaagcttcatcttctaccactcagggaagtacacagccagcagtgctccggagatgatgcacatctttttgmtatgtttttattttattttattttattttattttttgtttatttaaaaaaaaatagagacagggtctcactatgttgcccaggctggtctcgaatgcctg

SEQ ID NO: 80207 - DNA, 201 bp, Homo sapiens
tctctctctctctctgtgtgtgtgtgtgtgtgtgtgtgtgtgtgtatgtgtgtgtgtgtgtatgtatgtttaagatggttagaaatcatgaaactccaccrggcacagtggctccctcctgtaatcccagcactttgggaggccgaggcgggaggatcacttgaggtcatgatttcaagactagcttggccaccatggtga

SEQ ID NO: 80208 - DNA, 201 bp, Homo sapiens
cacagttattttgggaattgcagaggggatatttgtcttctttcccatccccctttctctctctctctctgtgtgtgtgtgtgtgtgtgtgtgtgtgtgtrtgtgtgtgtgtgtgtatgtatgtttaagatggttagaaatcatgaaactccaccgggcacagtggctccctcctgtaatcccagcactttgggaggccga

SEQ ID NO: 80209 - DNA, 201 bp, Homo sapiens
aacaataaagaaatacatactaaacatttacacagttattttgggaattgcagaggggatatttgtcttctttcccatccccctttctctctctctctctstgtgtgtgtgtgtgtgtgtgtgtgtgtgtatgtgtgtgtgtgtgtatgtatgtttaagatggttagaaatcatgaaactccaccgggcacagtggctccc

SEQ ID NO: 80210 - DNA, 201 bp, Homo sapiens
cgcaccattgcactccaacctgggcaacaagagtgaaactccatctgaaaggaagaaagaatccagcctgggcaataagagcgaaagagagagagagacasagagaagagagaaagaaaagagagtgtccttggtgttagatgccacagagagagaggggacaagaagatcgaggagtcaagaggagcttttgagccagat

SEQ ID NO: 80211 - DNA, 201 bp, Homo sapiens
cccatgagccatcacccttgccctccactctggtttggctgggatgctgggaagtggctttttcctgaggctctttagagaagaggtcccctcagcatggratgtgggccaagtctctgtgagctgcaattgcttcttgtctggaggccctgggaccctgtgaagagaggaataactgccacaaaccatttttcaaataat

SEQ ID NO: 80212 - DNA, 201 bp, Homo sapiens
gactgtaggcctggtaaacaaaagttggctgtaacatgagccaggatatggaagcgtgaccaatactttggactctctcaatgctggccctctgcggttcmtggctctcctccctttctcgctgtcaccagccacgtttaggtcagtctttgtttttggctgttgttcctgaagacgcatttatcaggtggatctcttaaa

SEQ ID NO: 80213 - DNA, 201 bp, Homo sapiens
tgggaaaccaagcctgagaaagcattcctgccttgctttatgtcacccagtaagtgaggcattcccactgcccaaccccttcccctgactgcagtgactgytgctgcttgcctggatggggaggaggagcaagcctcttcctcagcccctggcactccccagccacaccaacctgccgcaggccatccaaactccacggtt

SEQ ID NO: 80214 - DNA, 201 bp, Homo sapiens
ggcttcagataccctacccctaccccaaacttgggccaggccagtggctatggaactccagaaagaagggcctcagagagagagagggagaaggagagagwgtcatctacatcatgacagttgcaccttttccatgtgcaactggggaaagctgcggtccctcagcagccctttgccttcacttgggccaatgaccaaagg

SEQ ID NO: 80215 - DNA, 201 bp, Homo sapiens
gccagtttgtgtgagttcttgatcaaatagctatcaacaagataatgtgcatatatatgtgtgtatatgtgtatatatgtatatacacatatacacatatatgtgtgtatatgtgtatacacacacacactaactttataaataagttgaaatttatatgtaggatatatgtaagcagtatagtatataaatataaattac

SEQ ID NO: 80216 - DNA, 201 bp, Homo sapiens
gcactttgggaggctgaggcgtgcggatcacaaggtcaagagattgagaccatcctggccaacatggtgaaaccctgtctctactgaaaatacaaaaaatyagctgggcgtgttggcacacacctgtagtcccagctactccgggaggctgaggcaggaaaatcacttgaacccgggaggcggagcttgcagtgagctgag

SEQ ID NO: 80217 - DNA, 201 bp, Homo sapiens
taattgccagtttgtgtgagttcttgatcaaatagctatcaacaagataatgtgcatatatatgtgtgtatatgtgtatatatgtatatacacatatacayatatatgtgtgtatatgtgtatacacacacacactaactttataaataagttgaaatttatatgtaggatatatgtaagcagtatagtatataaatataa

SEQ ID NO: 80218 - DNA, 201 bp, Homo sapiens
cctgcatccctacgtgacactctgctttctgtggggcagccttgttattgcgaagaaccagtactactaacgtgcttttttaaaaaacaaaaattgtaatrgcttcaaggctgcatacacgttgccagaggaaaagcctgaggggatgggtggatatcgccttttaatttgctgttagttttccataaaggaacaaatgcc

SEQ ID NO: 80219 - DNA, 201 bp, Homo sapiens
actaacaggccaccccttgtccctccaggtggcagtgtgtctaggggggtctggaacttgggttttgaccagggtttgcagagcactgaatcccagccgcrtcatgagttggctgtgtccctatgccccagggcccccctcagggagaatggggataatgatagtcataatgataaatggggacagataatgctttgagaa

SEQ ID NO: 80220 - DNA, 201 bp, Homo sapiens
agtgtcctggggaagctgacattccacggacacaagcagccattcgtctgtctcattccgccaagacctctgtgaggtcttgttgacccctttgcatgatkatcttaagtttgttcaccactgttcagcatatgggcattaaaccctatttttgcattctccttcccactattttctcctactgattaagcggtatctcct

SEQ ID NO: 80221 - DNA, 201 bp, Homo sapiens
ctcgctcatactcctgaccagccccacatcctcgtgcatgtgtgggtgtaactttacattggatatacagatgcgactggactttaaatgggcttacatcyggataaacccatcgtaaagtcaaaaaaatattaagttggaccatcataggttagggactgtctgtagtttttacttattaattatgttattgacttaaac

SEQ ID NO: 80222 - DNA, 201 bp, Homo sapiens
cttgagaagtcttggaccacattccccatctgctggaatttatgttctgcccgaagtggatcgcctacttaacttttaattttttgtctgtgggttgatayctttctaaatcacaaaatcaccatgatgctaagcaaaagatgaagacgctaaaggtggtgaggtccaggaaactcagaatagggctttgtcgtctcatgg

SEQ ID NO: 80223 - DNA, 201 bp, Homo sapiens
tgttaacagttctaggtggagatacacaggcaatcaatctattcacccaacttctctgtatgtttggaaaagttcggaattaaaaacccaggataaataaactaaggcctatttcttcagccacattcaaagtccctgtagtctcacatctggaaaccctgcagtctgcctaggccgtgtcctccacctcaggccaaggtt

SEQ ID NO: 80224 - DNA, 201 bp, Homo sapiens
atctaggatgcagtggagtgagcagggttggtttatcaccaccctctggggatgctgggaatgtggttcctaaggggcagtgtggaaaagaggaaggcccygtgctgggagccccaccccctaggctcagggctggctcccttgtggtgtgaccatgggcacatttcctcatctgtaccatggagctaatccctacctgca

SEQ ID NO: 80225 - DNA, 201 bp, Homo sapiens
atgttaacagttctaggtggagatacacaggcaatcaatctattcacccaacttctctgtatgtttggaaaagttcggaattaaaaacccaggataaataaactaaggcctatttcttcagccacattcaaagtccctgtagtctcacatctggaaaccctgcagtctgcctaggccgtgtcctccacctcaggccaaggt

SEQ ID NO: 80226 - DNA, 201 bp, Homo sapiens
tctgtaccatggagctaatccctacctgcagcccagaagcctcgcggagctcaactaggaagaggcagccaatgtgttatacctgtgacgctctccactarccaaggcattaggatcttaagggcaagggcaaaacaggtacctttttagcaatgacataaataaaaacttggctacaccttataaggggccaggtgcggt

SEQ ID NO: 80227 - DNA, 201 bp, Homo sapiens
catttgggtgactatgcttccagattatttaattggcttttctcactgaacagtttgtccagcacactttattcaggtcaataaatgtggatgaccgggcrtggtagctcaaagctataatcccaagcactttgggaggctaaggcgaaaggatcacttaaggccaagagtttcagaccagcctgggcaacatagtgagac

SEQ ID NO: 80228 - DNA, 201 bp, Homo sapiens
gatgttaacagttctaggtggagatacacaggcaatcaatctattcacccaacttctctgtatgtttggaaaagttcggaattaaaaacccaggataaataaactaaggcctatttcttcagccacattcaaagtccctgtagtctcacatctggaaaccctgcagtctgcctaggccgtgtcctccacctcaggccaagg

SEQ ID NO: 80229 - DNA, 201 bp, Homo sapiens
aaaaaacccttagctgttagcagtcactctcctttatctcctgacaaccactcctctactttctgtctccatggagttgcccattctaggcatttcgtcaratggagtcatacaacatgtggccttttatgtccagcttttttcacttagtctaatgctttcagggttcacctatattgtagcgtgtatctgtacttcatt

SEQ ID NO: 80230 - DNA, 201 bp, Homo sapiens
agatgttaacagttctaggtggagatacacaggcaatcaatctattcacccaacttctctgtatgtttggaaaagttcggaattaaaaacccaggataaataaactaaggcctatttcttcagccacattcaaagtccctgtagtctcacatctggaaaccctgcagtctgcctaggccgtgtcctccacctcaggccaag

SEQ ID NO: 80231 - DNA, 201 bp, Homo sapiens
tcttctaccactcagggaagtacacagccagcagtgctccggagatgatgcacatctttttgctatgtttttattttattttattttattttattttttgkttatttaaaaaaaaatagagacagggtctcactatgttgcccaggctggtctcgaatgcctgggctcaagtgatccttccacctcgacctcccaaagtgc

SEQ ID NO: 80232 - DNA, 201 bp, Homo sapiens
taggcttgagccatcatacccagccagtaacattaacttttcatatcattatcttactcacaatatagattgaacttttggccgtgtcccaataatgtccrtgatagcccatgtgtttctcctggtcccgggttccacctggcatcatggattacatgtagccctcatgtctctttagttccctcgaatccagcagaggtc

SEQ ID NO: 80233 - DNA, 201 bp, Homo sapiens
cccgggaggcagaggctgcagtgagccaagactgggcaaaaaagcgagactttgtttcaaaaaaaaaaaaaaaagaaatcatgacattccatactttttcytttacttcccaaattactttccaataatagcatggtggaaagattaacaaagggggcttatgatatggttgacagaagttgggaggcttttggggtccta

SEQ ID NO: 80234 - DNA, 201 bp, Homo sapiens
ccacgagtgaaggatgcagtaaaggccgtagcaggccggggagcagcagggcagcatggtgcgttcagagtgcagtgaggactctgtgcagctggggtggrgggcggtgagggtggaagccagaaggatagggtggtgtgggattgctggtgagtttgggggctttatctcttgaccccagaaaccaaccagggaagtgtt

SEQ ID NO: 80235 - DNA, 201 bp, Homo sapiens
accagacctgtctccccaggtaaagcgcaggtcacaggctcctagaataccaataacttacacatttagtgactgaacacagatttcttacaagctccccrcatgccccacactctgcctggtcctctccagtgtgagaggacactcacacttgagtgtgacagccacacgtgagataatcactctgccaggcagtaggtg

SEQ ID NO: 80236 - DNA, 201 bp, Homo sapiens
atcctccattatttcttctccatttctttttaatcatatttcctcctctgaacttctaccctcagatttattcattatctaacaaatactgatggtgcagstccatggcccaaagctgttctgggggccacagcagtgatatgagtgtcctggggaagctgacattccacggacacaagcagccattcgtctgtctcattc

SEQ ID NO: 80237 - DNA, 201 bp, Homo sapiens
tggttgtgctggaatggatcggttctctccaccacttaaagttcagcttagttgtcattcgtgtccccccccccaaaatgacatagggcgtggtgaggctrgtagtgattgtaaatatatgctcgctcctgttataatcgtttggaaattgacccagtacagggcatgtggcatgaaaatgcaggccaccccaatggcctg

SEQ ID NO: 80238 - DNA, 201 bp, Homo sapiens
tctttttgtgttctctaaaaaggttaaattcagagattttttttttttttttttagatggagtctcgctctgttgccaggctggaatgcaatggcgtgatytcggttcactgcaacctccgattctctggttcaagtgattctcctgcctcagtctcctgagtagctgggattacaggcacacaccaccacgcctggctaa

SEQ ID NO: 80239 - DNA, 201 bp, Homo sapiens; identical to SEQ ID NO: 29751

SEQ ID NO: 80240 - DNA, 201 bp, Homo sapiens; identical to SEQ ID NO: 29752

SEQ ID NO: 80241 - DNA, 201 bp, Homo sapiens; identical to SEQ ID NO: 29753

SEQ ID NO: 80242 - DNA, 201 bp, Homo sapiens
gagaatgagaaggaggatgaagaaagttgcaaaacccagcaaaaagtacccaaaagcaaccactcacagcaaaaattgggggaatgagtgatttaaccccrcaaggcatacactttctaggactttacaaataagaacacctttagtccctacagcaaccctcccatgaggtatgtgcttgctgttctttgtccctatttt

SEQ ID NO: 80243 - DNA, 201 bp, Homo sapiens
ggactgggagaagatgaatttttcctgaaatgatgtcaggagaggagacggtgaaaggggatttctgtctcagggaccagctctacctgacagtggaaccwctgaggacagaggaaagctgcccacagcctaagcccttcttttccccagtatgcccgggcctctgaccctcctccccttttgtgtgtttcatcccacctg

SEQ ID NO: 80244 - DNA, 201 bp, Homo sapiens
ctggtgcaatcatagctcactgtagcttcaaactcctgggcccaagcaatccccccacctcagcctcctgagtagctgggactataggtgtgtgccatcaygccctgctaatttttctaaattttttgtagagacaaggtttcgaaatcctggcctcaagtgatcctcttgccttagcctcccaaagtgccgggattacag

SEQ ID NO: 80245 - DNA, 201 bp, Homo sapiens
gggactgggagaagatgaatttttcctgaaatgatgtcaggagaggagacggtgaaaggggatttctgtctcagggaccagctctacctgacagtggaacytctgaggacagaggaaagctgcccacagcctaagcccttcttttccccagtatgcccgggcctctgaccctcctccccttttgtgtgtttcatcccacct

SEQ ID NO: 80246 - DNA, 201 bp, Homo sapiens
gccctacttacattctaatttagagacaccttttacatgccaacctagggaaatttagatttacacttttctttttttttttcttttctttctttttttaracagggtctcactctgtcgcccaggctggagtgtagtggtgtgatcttggctcactgcaacctccacctcctgggttcaagtgattctcctgcctcagcc

SEQ ID NO: 80247 - DNA, 201 bp, Homo sapiens
gtaaaaaagcaagtgggcaatttgtgttctctattgtgttccattgatctccatgtctagccctctaccaagaccatgctgtcacagttactggagctatrtagtaagccttaacactgggaagagagattcctttattctttttcaaaatagttttggctcttctagggcctttctcttatgttcacaaggaaacttata

SEQ ID NO: 80248 - DNA, 201 bp, Homo sapiens
tcaagtcgtccctggtcaacgagtcggagaaccagagcagcagctcggactcggaggtaaggaagcaccgcggccacccccgggggatcccggccctgcgkccgctcacccgctcttgcctttgtgtctcctccgcaggcggagaggcgcccgcagcccgtccgggacactttccagaagccgcgggactatttcgccgaa

SEQ ID NO: 80249 - DNA, 201 bp, Homo sapiens
gtgaagacaggagcagggcccccgagccctgagaaaaagcagggaccttgccaggtgaggaaaaaaatggtatgaggtagggctacactacgctcccagaracgtctccatggacagtgagctctttagaggggaaaggagtaagcttttgaaccatttgaattatttagaagaaaaaaacacagtgcctttcttacacac

SEQ ID NO: 80250 - DNA, 201 bp, Homo sapiens
gttgttttaagccaccaagttttcgtgatttgtgacagtagcagcagaaaactagtacaataggtttttcatatatttatggaccataaacatgaaaaatmgtctgacttttaaatcttataaaaataaaataacacacaataatacaaagagtatgattctatgtatgtacatcagaatatctgtaaatacgtttacata

SEQ ID NO: 80251 - DNA, 201 bp, Homo sapiens
gtcaacacctccatttctactcagtgaaactgacagtggacttctgtcttccacaactatgagaggataaacttctgttgttttaagccaccaagttttcrtgatttgtgacagtagcagcagaaaactagtacaataggtttttcatatatttatggaccataaacatgaaaaatcgtctgacttttaaatcttataaaa

SEQ ID NO: 80252 - DNA, 201 bp, Homo sapiens
tgaatttcatataattttcatgtgtcataaatattatccttatttttatttttattttttgggacaaaatttcgctcttgttgcccaggctggagcgcaayggcgcgatctcggctcactgcaacctccgcctcccgggttacaggcatctgctaccacgcctggctaattttttttttttttttttttttgaaacggagt

SEQ ID NO: 80253 - DNA, 201 bp, Homo sapiens
aatacatctacttttcttttcttgttttgacataatggatatgccctggtaataaaaatttaaaataaatgtcgcagtacagagatatgcatggcactgaraacactgtatcaccgtgatttgtggtgtactgagcagcagtatgaagtgataagagcatatactgtccctgttgcaactacagtcaggcaccatataaca

SEQ ID NO: 80254 - DNA, 201 bp, Homo sapiens
tgcattgtaatccccatgagttgaaggaggggcctcgtggaggtgactgaatcacggggcagggggaccttctttcttgctgttctcatggtagagttctyacgagatctggttgtttgaaaatgtgtagcgcttcctctctgtctctctctcctgccaccatgtgaagaagtcgcttgcttccccttcaccttctgccat

SEQ ID NO: 80255 - DNA, 201 bp, Homo sapiens
ccaaagcatggtcagggcatcttctgaggatgatggggatcctgcaactaagccagccaaacttgagtctagaattgtgtgcccccaggtgcccttgagcycagggtaaatagctggtgtgattacagcaaccagcagtgtgtgccatatcacagtaaacactccaggagtgggttctcacagaagaatcaggaggaaacc

SEQ ID NO: 80256 - DNA, 201 bp, Homo sapiens
actgcacagacactgcccaggcccagcaaacccaaggtcacagccgatgggagaggcagcttgcgactcagcaggaccagcactccaggctgcagaaatgyggactcgaaagcaagttgaactttgacattgtttgaaagcctagggctctgtcccggcgtccccctggtcagggccaccacagaatggctgtgcctagtg

SEQ ID NO: 80257 - DNA, 201 bp, Homo sapiens
cactttgggaggctgaggcagacagatagcctgagctcaggagttcgagaccagcctgggtaacttggcaaaaccctgtctctacaaaaaaaaaaaaaaaacaaaaaccaaaaaaaacattagccaggagtggtaacgtgtgcctgtaatcgcagctactcaggaagctgaggtgggaggattgcttgagcccaggctgtt

SEQ ID NO: 80258 - DNA, 201 bp, Homo sapiens
acattaacttttcatatcattatcttactcacaatatagattgaacttttggccgtgtcccaataatgtccgtgatagcccatgtgtttctcctggtcccrggttccacctggcatcatggattacatgtagccctcatgtctctttagttccctcgaatccagcagaggtccttagcctgtctttgtctttcttgacctt

SEQ ID NO: 80259 - DNA, 201 bp, Homo sapiens
tctactaaaaatacagaaatcagctgggcgtggtggcaggtgcctgtaatcccgggtactcaggaggctgaggtaggagaatcacttgaacccaggaggcrgcacctgtatcccagctacttgggaggctgaggcaggagaattgctttaacctgggaggcagaggttgcagtgagctgagatcgcaccattgcactccaa

SEQ ID NO: 80260 - DNA, 201 bp, Homo sapiens
ttgacggggggcggtggaagagactctgactgagagagaggggaatggggagtgggactacacagacctcacagttttgccccgagagggagggaggtctcttgcagctttggccctgctggcctggagcaccccaggaagtcctgaatgtaagtgtcagttttgcagtgaaaactggatgtgggtctatggctgttgctt

SEQ ID NO: 80261 - DNA, 201 bp, Homo sapiens
aaaaaaaaaaaaaaaaatcagttgcctgaaatagtgcttgtacttacagattaagtcaccaaggggcagaattttgtgcctgctgaaatttgaaaaaatartcttgcagccaaaagagagaaaaatgtgtttctttcctaaactatggtaatagtaaaagtatgtgatgctttttgttaagttttattttaatggaaatat

SEQ ID NO: 80262 - DNA, 201 bp, Homo sapiens
attgacggggggcggtggaagagactctgactgagagagaggggaatggggagtgggactacacagacctcacagttttgccccgagagggagggaggtctcttgcagctttggccctgctggcctggagcaccccaggaagtcctgaatgtaagtgtcagttttgcagtgaaaactggatgtgggtctatggctgttgct

SEQ ID NO: 80263 - DNA, 201 bp, Homo sapiens
catgcagcccatgatgaagccttttgactgagatggggagtagagaggggtcttgagcagaaaggtgacgtgatccaacctttgttttaacgtagcgccayggctgccatgatataatcatagaccgaaggggtcaagggtagaaaatcagagacaagttgttgggccagtggggcctggatggtggcagtagaaatgggg

SEQ ID NO: 80264 - DNA, 201 bp, Homo sapiens
tggagcgcaatggcgcgatctcggctcactgcaacctccgcctcccgggttacaggcatctgctaccacgcctggctaattttttttttttttttttttttgaaacggagtctcgctctgtcgcccaggctggagtgcagtggcacgatctcggctcactgcaagctccgtctcccgggttcacgccattctcctgcctca

SEQ ID NO: 80265 - DNA, 201 bp, Homo sapiens
tgggtttgcatccctacaagaagccccctctgtctttttgcaggtgcttgagcaagtacaccatgctagtgagcagttcaacagaatccattttcttagaraaactggtgaagtgaacacagcttaccaggatacaatatccaaattagcacactaccttttattgttattaatatcaccatgaccgctattattaacctc

SEQ ID NO: 80266 - DNA, 201 bp, Homo sapiens
gtggggcaggtgcccagagccaggaatgagccgcctgtggtgattcctgtgtgtctggagtccaggagtcccttgcactgttggccagtggtcactgtgcrgtgattgactgggctcagtgtctgtagcttttgtctgagccccttgcacccctccccggggatgattgtctgagttggtggatgttaatctgcagcccct

SEQ ID NO: 80267 - DNA, 201 bp, Homo sapiens
aacaattaaaaagttaattctgtttaccaattgtagaacgcacaggtttttcccatgttaacatctctgaagatgtgtctgtggcgtgccagcgtttttcycaatagctttataaaataatggtgctccttccatttggtggtgttttacacagaatgtggtagtgaggtcagcagagtaaagtgttacagagagaagtgt

SEQ ID NO: 80268 - DNA, 201 bp, Homo sapiens; identical to SEQ ID NO: 5505

SEQ ID NO: 80269 - DNA, 201 bp, Homo sapiens
actatgtattattttgtggattttttaacacaaagaggattctgttatttctatttgataacttgcttccccccccccccccacttaatagggtatctcaragacctttcgatgtcagtacatacgcgcttacctcattctaattagccactgtgtggtattccatagtagagatgtaccttgtaagcattcccatgttgg

SEQ ID NO: 80270 - DNA, 201 bp, Homo sapiens
cccagcttctcaggaggctgaggcaggaggattgcttgagctcaggagctcaagactgcagtgagttatgattgtgccactgcattccagccttctcaacrgagtaagactctgcctcaaacaaaaaaggtatacaattcaggctgggtgcgatggctcacacctgtaatcctagcactttgggaggccgaggcgggtgga

SEQ ID NO: 80271 - DNA, 201 bp, Homo sapiens
atcccagcactttgggaggctgaggcagtgggattcttgaagccaggagtttgagaccagcctgggcaacatagcaagatcccatctgttaaaaaaaaaaattagctgggtgtggtgatgtgtgcctatagtcccagctactcaagaggttgaggtgggaggatcgcatgagcccaggaggccacagtgagccatgttcgt

SEQ ID NO: 80272 - DNA, 201 bp, Homo sapiens
cgtaaagcagtgaggccaaactggcttttatttatttatttatttaagacagtcttgctgtgtcgcccaagctggagtgcagtagtgtgatctcagctcamtgcagccttgacctcccgggctcaagcagtcctcctccctcagcctcccgagttgctgggaccacaggcgcatgccaccatgcccttgcccagctaattt

SEQ ID NO: 80273 - DNA, 201 bp, Homo sapiens
taaagcacggggcctggctccataggcagtgtgtggggtggctctgcccaagtctagcccagctgtgggccgtgcttccctacaccaagacacgtttgccmtaaactgaacatttttaaatagattcatcagtctaagcagacacagaagtgcaaccgtaaagcagtgaggccaaactggcttttatttatttatttattt

SEQ ID NO: 80274 - DNA, 201 bp, Homo sapiens
tgaggtgcagcatgacccttgaggagcttaccgtcccaagggcagacagagtgtgcaaatggggaggagtagcctggtgagtgctatggaaacaccgtgtrccgcttctcgagagcgacagactcatggaggcttcatgccagggagggtgaccttgggaggaaatgggttttgaagaagaggggttaaagtttcccacga

SEQ ID NO: 80275 - DNA, 201 bp, Homo sapiens
gggatttttcattgtgtagcagacatatggcttagtgtttgatttaaaaaataggaagttggtggccattttcatgaatagtttgacagccagtcagaagygtgattgtcgttttacctaaacgcaactgctgttgttcgtaaggtcagaaacctgctcacaggggcgggggcggggaggtctggtctgttggctgtttga

SEQ ID NO: 80276 - DNA, 201 bp, Homo sapiens; identical to SEQ ID NO: 5506

SEQ ID NO: 80277 - DNA, 201 bp, Homo sapiens
ccggccttgtgctaatcttgctggaatgtaactagttcgggcagtttctggcttcgatgtgctttggggccggttggcgtcccccccgccccaacccagtwcatcgatggtgcgtccgcgcgccgaaggctgctctttgtgttctctgcagccacagcttagaagcgtccgagtcagaccgctttcagttgtaaggatggg

SEQ ID NO: 80278 - DNA, 201 bp, Homo sapiens
tcagctcacagagggctgtggtgccagctgctggccacacatgcccacggggctgctctggccctgcctgaccctgactggcttccccttgcatcccctgrggagcccacgcccactgcacagcatacccaccaggtgctgctgccctcctgaactctgtgggacacactgctgcccacgtggggactgccccggaatcag

SEQ ID NO: 80279 - DNA, 201 bp, Homo sapiens
ctgccctcctgaactctgtgggacacactgctgcccacgtggggactgccccggaatcaggaccctggatttctcctctgctacctgccccctcccgccaygtagtgagggttccacattatgaatgtcatggttccttccggctcttgattttccatgattcgggatcaggaaatgattttcctctgagtatttttaggc

SEQ ID NO: 80280 - DNA, 201 bp, Homo sapiens
gcaccacacacagtggctgcgcatggtggatgcacagtgagtatttgtggaatgagcggccgagccgctgcagactgatgagtgttctggggcctgtgttkgttttctaaaactgctctgtcagtaagcgccccgccaatccccgtgtaaacatattcagatcctaaagaagatcaggcagccaccctttaaaaagcccga

SEQ ID NO: 80281 - DNA, 201 bp, Homo sapiens
ctggtcttgaactcatggcctcaagcaatcctcccacctcagcctcataaagcaccaggattacaggcataagccactgtgcccgctctgtcttatctaaytgggtaatcactcaataaaattaagttcttattttttcatttgaatgaattgtatcgatacctgggagaagccaaaggttgctttgttagttgtaactcc

SEQ ID NO: 80282 - DNA, 201 bp, Homo sapiens
aaatagaccttgtacgtgaggcctggccatttgttaacccgtgtgaaagatgtttcggtggccatttaatgaacatatgttgaataatgtgctgtactgtrtaccacagatacaaaggggaaaaagatacagaaggaaaaaagaaaactcagtatcacatactcagccccttctgatagaacaggtgtgtccaagcagcaa

SEQ ID NO: 80283 - DNA, 201 bp, Homo sapiens
aaccgcgtctctacaaaatattagcgaggtgtggcagtgcgcatctgtagtcccagctacttgggaggctgaggtgggaggattgcttgagcctgggaggyagaggctgcagtgaaccgagattgcaccactgcactccagcctgggcaacagagcgagaccttgtctcaaacacacacacacacacacacacacacacac

SEQ ID NO: 80284 - DNA, 201 bp, Homo sapiens; identical to SEQ ID NO: 29744

SEQ ID NO: 80285 - DNA, 201 bp, Homo sapiens
accttccctggtcatcctgggaaacatcctgtttaacctgctcaccccctctatatttcttttctactttctcttagtttttcttcttagcattttaacaytgtattaaaatattttaataaacttatttatctaatattttttattttattttatttttgtttgagacagagtctccctctgtcgctcaggatggagtgc

SEQ ID NO: 80286 - DNA, 201 bp, Homo sapiens
aatttaggtgtggcctgaacactgggattttttttttttttttttttttttttttgagatggggtctccctctgtcgcccaggctggagtgcagtggcacratcttggctcactgcaagctccacttcccggattcacgccattcgcctgcctcagcctcctgagtagctgggactacaggcacccgccaccacgcccggc

SEQ ID NO: 80287 - DNA, 201 bp, Homo sapiens
ctgcttcatataatagatgttgttttccatcagagatactgattatctctctgtgatgtcagcagctactaattatcagcacccacatcctttacctcatwtgcagtttcaaaatggtgatagtctatttgtatcattcccttgtctatcagttataatatttttaaaaagagaaactacccctcaccaactctttagtta

SEQ ID NO: 80288 - DNA, 201 bp, Homo sapiens
ccgggttcaagcaattctccctgcctcagcctcccaagtagctgggattacaggcgcctgccaccacacatggctaatttttgtatttttttagtagagayggggtttcaccatgatagccaggctggtcttgaactcctgacctcaggtgatctgcccgccttggcctcccaaagtgctggaattacaggcgtgagccac

SEQ ID NO: 80289 - DNA, 201 bp, Homo sapiens
gcgatcatcccttcacaatcccagagtggcaggcgggaccagccccatggtctggctcctgtcacctgggtccgtgccagcacaatctgccaaagttctasagaccctgttcccttccccatcacctcacatgcttcttctgtgtgtatttctttttgtttttatggtttttggagcaatttaaactcccagttgtttatt

SEQ ID NO: 80290 - DNA, 201 bp, Homo sapiens
actgcttcccatgggcagtcttgctcatatcctgggagctcctgttctttcagacccaaaggaacccaagcagaaatctttgtatgtatatgtatgaagargttgtctgtttttaggagttgtatgtaaaagctaaggaaaccttttcttttggaagatcagtataaacatgctgcttttggtaaaattcttttgagccat

SEQ ID NO: 80291 - DNA, 201 bp, Homo sapiens
tcaaggtgcctgccacttcctcagcgaagaagtctgtgttcctccccgtccttgccagtggcgatcatcccttcacaatcccagagtggcaggcgggaccrgccccatggtctggctcctgtcacctgggtccgtgccagcacaatctgccaaagttctagagaccctgttcccttccccatcacctcacatgcttcttct

SEQ ID NO: 80292 - DNA, 201 bp, Homo sapiens
gtgacctgtagatgtttttaaaataaaaagccttatggataagtcagattaggtttaaacaattaaaaagttaattctgtttaccaattgtagaacgcacrggtttttcccatgttaacatctctgaagatgtgtctgtggcgtgccagcgtttttctcaatagctttataaaataatggtgctccttccatttggtggtg

SEQ ID NO: 80293 - DNA, 201 bp, Homo sapiens
actttagccttgtcattttttttttcatctgtgcctcccctgtaccttctccaccatagggtcacgataaggcccacaggaattaaatgcagtaaagcacrgggcctggctccataggcagtgtgtggggtggctctgcccaagtctagcccagctgtgggccgtgcttccctacaccaagacacgtttgccctaaactga

SEQ ID NO: 80294 - DNA, 201 bp, Homo sapiens
  misc_feature (1)...(201): n = A,T,C or G, or insertion/deletion polymorphism (see Tables 1-2)
gagtgtttttatatatttaatttttttaattaaaaagtgattcccattgcatatatttgcatttaccttttaaaatcaatgtatgtttagccaaaagaatnaaataaaaacacccataatcttgtctcccagagagattaagttcaactcacctcttagtgtatattcttccagatttctcaacacatacataaagatacc

SEQ ID NO: 80295 - DNA, 201 bp, Homo sapiens
atccaggaaggtcatctttgaaagagaagcccaaacaatgggtagaaactacagaaagttatggaggggtaggtgtgagcatttggggaccactctgatckcacattaatattacctgggagcttaaaaaaaaaaaaagtagatgcttaagccccaccctggaagagttaaatcataatggggaacgcagacaggaatcag

SEQ ID NO: 80296 - DNA, 201 bp, Homo sapiens
atctgtactaaaaatacaaaaaaattagccaggcgtgatggcagacgcctgtaatcccagctactccagaggctgagacaggagaattgctggaatccggraggcagaggctgcagtgagccgagatcatgctactgcactccagcctgggtgacagagcaagactccatctcaaaaaacaaaacaaaacaaaaaaaaaac

SEQ ID NO: 80297 - DNA, 201 bp, Homo sapiens; identical to SEQ ID NO: 29763

SEQ ID NO: 80298 - DNA, 201 bp, Homo sapiens; identical to SEQ ID NO: 29765

SEQ ID NO: 80299 - DNA, 201 bp, Homo sapiens
tgcctgtgctgtgtgctgtttgccactgggccactagttgaggaaagtttttctttacagaagtatttcagctaataaatgaagaagaaatagtcttgttycctgtcttagttcattttgtgttgctgtaacagcacaccacaaactgggtaatttataaaggaaagatatttacttggctcacagttaaggaggctggga

SEQ ID NO: 80300 - DNA, 201 bp, Homo sapiens
aaatggaacttttcaaaataaaaaattgaagacactcattgaacctataaattgtggataatacatatgtagtgaaatatattcaatgaaaaacatgcagrggtatgacaagcagtacctttaggacaacattacttctgggagggcagataaatgaatgacagatcggatacttgagctatatcaataacactttatttc

SEQ ID NO: 80301 - DNA, 201 bp, Homo sapiens
ctaagcatactggtgttggcgaggatgtttgttaataaatgacacatttgcgtattatattgaggaatgatttggcaatatctagtaaaatcaaagatgcrcatatcttatgacccagcaaatctactacacatgagcacaagggacatgaacaagaacgctccttgctgcattgtttacagtagcataaactagaaacaa

SEQ ID NO: 80302 - DNA, 201 bp, Homo sapiens
cgtatgttgggaaattaatcagaccaacgttagccccttcctcccggccctggaagaatgcctggtgtgtgtgcatccccctctccagttagcaattaccraacaacttctgtggctaccaaggagagcatgatagggtcccagccctccagagcttacaatgtaagagaacaaacaggaacatgagtctttacaatacct

SEQ ID NO: 80303 - DNA, 201 bp, Homo sapiens
tgattgtggttgttacacaaagctacacatgtgacaaaattacatagggctacacatacacacacacacacgagtgtttgtaaaactggtgaaatctgagwaagttctgtggagtgtgccaatctcaatatcctagttttgatagcatgctagttagctatgcaagacgttaacatcgggggaggctaggctagatgcttg

SEQ ID NO: 80304 - DNA, 201 bp, Homo sapiens; identical to SEQ ID NO: 29769

SEQ ID NO: 80305 - DNA, 201 bp, Homo sapiens
aggcctcctagtctgtttgtatgcactgctgcctcatttaacttgagacttagatcctcggagcagcctgccaggagatacgagtttacctcccagtcagragacaacacaggggattttttttttttttttttttttttgagacggagtctcgctctgtcgcctaggctggagtgcagtggtgcaatctcggctcactgc

SEQ ID NO: 80306 - DNA, 201 bp, Homo sapiens; identical to SEQ ID NO: 29770

SEQ ID NO: 80307 - DNA, 201 bp, Homo sapiens
cggggagggcatgtaagcagcctgtgtacatgcggggaagggaaagggggagaaccagaaggggcagctgcccaccagcagcttcctgggctctcctcccrcctcctcctcactcacaacagcgcacagactcagcctcagctccttctctctggcctcttccacctgagtgaagatcaagtgcaggagaggttgcacagg

SEQ ID NO: 80308 - DNA, 201 bp, Homo sapiens
tttggagaggcaaaagcaacccaaataaagtaagtgaggacttagtgcagactgcaagtgtattagccagaggtggcattacagagcccagctcaggatayggaatggctccagcaactctgtactgctcaacccacttctggagcttcaggcttagttctaggagctgcagtttcaccaggacttagacaaacagatgat

SEQ ID NO: 80309 - DNA, 201 bp, Homo sapiens
atgggtagaaactacagaaagttatggaggggtaggtgtgagcatttggggaccactctgatcgcacattaatattacctgggagcttaaaaaaaaaaaaagtagatgcttaagccccaccctggaagagttaaatcataatggggaacgcagacaggaatcagtgtttttaaagctcctcccagcagccctggtgccagt

SEQ ID NO: 80310 - DNA, 201 bp, Homo sapiens
ctcctccctaacccaactagcctagcctggatgcttgaaattccataaagaccaagccctggatttgattggagagttgggggaatgtgttgcagcccctytcccaacccagaaagaaggcatgtaatgtgctaacgccgttaggagtgtttatggcatatgggttatgatattgaatttgtccaataaaccatcaggaaa

SEQ ID NO: 80311 - DNA, 201 bp, Homo sapiens
gaggtgggaggatcgcatgagcccaggaggccacagtgagccatgttcgtgccactgcactccagcctgggcaacagagcaagacagcatctctttttttkttgtaagacaaacaatcccatagcatttattgccatcttgtaataacataagggtaatcaaaacaatatgaataaatgttcatattggacaaaggacagc

SEQ ID NO: 80312 - DNA, 201 bp, Homo sapiens
cttgaacctgggaggcagaggttgcaatgagccaagatcgcgccactgcactccagcctgggcaacagagcgagactccatctaaaaaaaaaaaaaaaacmaaaaaaaaacaagaatgaaaaggaagcaagtaaattaattttaatagtatatcttatgtaacccaattcatcaacagtattagcatttcaacatgtaatc

SEQ ID NO: 80313 - DNA, 201 bp, Homo sapiens
aaagctggcaagtttaaactaagtgatatttagtctgggtgggatactgatcatgcatttttctttcttttttcttgctctaaagggcattattagggccrggtgcagtggctcatgcctgtaatcttagcactttgggaggccaaggtggcaggattgcttgaacccaggagttcaagaccagcctaggcaacaaagcga

SEQ ID NO: 80314 - DNA, 201 bp, Homo sapiens
ggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttcttctgcc

SEQ ID NO: 80315 - DNA, 201 bp, Homo sapiens
gcccacagcctgacagggagcactggagacaggcaggaggcagaaaaacagaaacagcaccatggggggatatatagaagcactctgcggggaggaggggygcatgattttgattacagcacagggtacctattgattgaattattaataaagattaaattgaatcacacatatcctatatatgaaggcaggggaatcgca

SEQ ID NO: 80316 - DNA, 201 bp, Homo sapiens
gggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttcttctgc

SEQ ID NO: 80317 - DNA, 201 bp, Homo sapiens
ctgggcagtgagcatagacactgcacagacactgcccaggcccagcaaacccaaggtcacagccgatgggagaggcagcttgcgactcagcaggaccagcrctccaggctgcagaaatgtggactcgaaagcaagttgaactttgacattgtttgaaagcctagggctctgtcccggcgtccccctggtcagggccaccac

SEQ ID NO: 80318 - DNA, 201 bp, Homo sapiens
ggggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttcttctg

SEQ ID NO: 80319 - DNA, 201 bp, Homo sapiens
tgaggggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttctt

SEQ ID NO: 80320 - DNA, 201 bp, Homo sapiens; identical to SEQ ID NO: 29730

SEQ ID NO: 80321 - DNA, 201 bp, Homo sapiens
tgtctcactttgtgatggctaatttatgagggctgctgtcaggttatagattctccatttttaccagaaacttccaccttgagccttataatggatccacyggaatgaagatatgtattctaggcaaggatttaggtaggggagaaccatgaacctggcacacagtagcactaaacagtgtttaatgggtaagtgggtgga

SEQ ID NO: 80322 - DNA, 201 bp, Homo sapiens
ctcatctcaccaacagctttttcttttctgttccctgtgcagtacctgcagatgaaatggcccctcctcgatgtcccctccagcgccacagtcaaggacaygaggtcaccatctccagcacacttggtaagtctgtttcaccttaaagcaccaaagggccactattagtggcctcatcccatgccactgccttctgccatc

SEQ ID NO: 80323 - DNA, 201 bp, Homo sapiens
gtctcggtcctcaaacagctgcttgtgaaagttaagttctgtaaccaacttcatgcacaggctatgcctagaattggtgttctactaggtcagtcaggaartgacaggggatttgagaaatgtttttagagcctttgtgctctgaaatgtaccctcctccctaacccaactagcctagcctggatgcttgaaattccataa

SEQ ID NO: 80324 - DNA, 201 bp, Homo sapiens
gaacaagacctgatcaccacccagtctcggtcctcaaacagctgcttgtgaaagttaagttctgtaaccaacttcatgcacaggctatgcctagaattggygttctactaggtcagtcaggaagtgacaggggatttgagaaatgtttttagagcctttgtgctctgaaatgtaccctcctccctaacccaactagcctag

SEQ ID NO: 80325 - DNA, 201 bp, Homo sapiens
gatgcttagagcagggacagaagtcgttggaggaggatggaagggagcattgggtaaggtaggagaagcacttagggactcccctccccctttcttttccctccatggtggaagctggagggaaagaaagtgggaggccaggtgcagtggctcatgtctgtaatcccagctctttgggaggtcaaggcgggtggatcacct

SEQ ID NO: 80326 - DNA, 201 bp, Homo sapiens
caggagtttaaggctacagggaactatgatctccctactgcactccagcctgagtgacagagcaagaccctgtctccaaaaaaaaaaaaaaaaaaaaaaaattagtcacaaacattttcatgttgtttgggtatttgtttttccattcaacatttaatccttgagtaggtcctagcagtctgggcagtgtcttagggacta

SEQ ID NO: 80327 - DNA, 201 bp, Homo sapiens
tcacttgaggtcaggagttcgagaccaacctggccaacatgttgaaaccccatctctactaaaaatacaaaaattagccaggtgtgtggcacatgcctgtmatcccagctacttaggaggctgaggcacaagaatcacttgaacccgggaggcagagtttgcagtaagccgaaagcgcaccactgcactccaccctgggcg

SEQ ID NO: 80328 - DNA, 201 bp, Homo sapiens
cctccactgttatttttcttccagtgacatattcaggaagagcaagatctcaaaaaatataaatgttgatgttccccatccaatcccggttgtcattagartgtttatacttatccacgcagtgcttcagttctggaatatattcatctttaccttaccctggttagcaataacagcaacaggaattaaaaccagtgggct

SEQ ID NO: 80329 - DNA, 201 bp, Homo sapiens
tacaagcctgtacagcatatgctactgtactgaatactgtaggtgactgtgacacagtggtgagtgtttatgtatctaaacatagaaaaggtggctgggcrtggtggctcacgcctgtaatcccagcactttgggaggccgaggcaggtggatcacttgaggtcaggcaggtggatcacttgaggtcaggagttcgagacc

SEQ ID NO: 80330 - DNA, 201 bp, Homo sapiens
tcctgggcccattccaaagcgcagaaggtgcagcactggaattaaggggctgtctcccaggggtgacaggcacatacacccaggcaatggggagcgacacytttgcacagaaacccaccgaggcagctattgcatttcctgattatgaggtgatttatttcctctaaaaatgtatcctatagccctttcccagggagtcta

SEQ ID NO: 80331 - DNA, 201 bp, Homo sapiens
ttgtctaaatgctttgtgatacaattatgatatagtttgcatttctttcttagaaagtttgtgttattcatagtatatttttttaagtagtagatcatggkgaaagtaaagttggaaaatatggaaagagagacaataaagacaaagttacccatagtttcaccactcaaatataacttgtttacatttttggtgtgcttc

SEQ ID NO: 80332 - DNA, 201 bp, Homo sapiens
tatttggtgtgtgttcttcctggctggtttgaatatatacatatacaactactatgtattattttgtggattttttaacacaaagaggattctgttatttytatttgataacttgcttccccccccccccccacttaatagggtatctcagagacctttcgatgtcagtacatacgcgcttacctcattctaattagccac

SEQ ID NO: 80333 - DNA, 201 bp, Homo sapiens
ctgcttaacatgccaattctcaaaaatattcattggaatttcccttttacaactgtacatacagccaggcacggtgactcacacctgtaatcccagcactytgggaatctgaggtgggaggatcacttgagctcaggagttcgggaccagcctgggcaacatagtgcgacctcacctttactaaaaataaaaaaaattagc

SEQ ID NO: 80334 - DNA, 201 bp, Homo sapiens
gaaagaaaaggaaggaagggaagaagggaagaaaataaattctaaatagattaaaaagaagtttaaaaaacttaaaagatacctttaacagtattgaaaaygatgttgaagcatcctataaaagccacagcaagtgataatgatgtgataatagatgaaaagaacgcaagggaaatctcctaaacgactcaaactatacag

SEQ ID NO: 80335 - DNA, 201 bp, Homo sapiens; identical to SEQ ID NO: 29739

SEQ ID NO: 80336 - DNA, 201 bp, Homo sapiens
cgagcattgggaattttaaaagctctctggatgatttcaactctgggtgaatcacactttgcagaatttgattcagtgggtcgcggtaggtcgagcctgaraatttgcattctaacaagtttccaggtgatgcttatgctgctggtctggggactgagctttgagaaccactggcatagggacattgtctgcactagtaat

SEQ ID NO: 80337 - DNA, 201 bp, Homo sapiens
aaatatattccaatcagacatggtggctcacgcctgtaattccagcactttgggaggccaagatggaaggatcacttaaggccaggagttcaagaccagcytgagcaacatagcaagaccctgtctctacaaaaaaaaattttaaattagccaggcgtggtggtgtgtgcctgtagtcacagctactcaggaggctgaggt

SEQ ID NO: 80338 - DNA, 201 bp, Homo sapiens
tgctgggattacaggcgtgagccaccacgcctggccgagcattgggaattttaaaagctctctggatgatttcaactctgggtgaatcacactttgcagartttgattcagtgggtcgcggtaggtcgagcctgagaatttgcattctaacaagtttccaggtgatgcttatgctgctggtctggggactgagctttgaga

SEQ ID NO: 80339 - DNA, 201 bp, Homo sapiens
atttttttgagatggagtctcactgtcacccaggctgaagtgcagtggtgcgatctcagctcactgtaacctccaccttgcaaattcaagtgattctcctrccttagccttctgagtagctgggactacaggcacatgtcaccatgcccagttaatgttttgtatttttagtagagatggggtttcaccgtgttggccagg

SEQ ID NO: 80340 - DNA, 201 bp, Homo sapiens
tggatggggaggaggagcaagcctcttcctcagcccctggcactccccagccacaccaacctgccgcaggccatccaaactccacggtttcagggccttgygtgcaggtttctctgcctaggttggtgttacctcacttctcacttggacagtttccacttaccacccccagcctaagtaagtcctcctcttctttttcct

SEQ ID NO: 80341 - DNA, 201 bp, Homo sapiens
agatgccaggggcaagtgtatccctgaatagtttatgattcatttgagccttttgtgcccacataaacgatgtcattcttcttctcttaaagacaaacttygctatattgcttaggctggactcaaactcctgggctcaagggatcctcccacctcaacatcctgagtagctaggactataggcgcaggccactgcaccca

SEQ ID NO: 80342 - DNA, 201 bp, Homo sapiens
tggtctcataatcctgggctcaagccatcctcctgcctcggcctcccaaagtgctgggattacaggtgtgagccaccatacctggccctattttctttctyaaaaaccataaaaagagtcctactctgaatatttttatcagtagcattcttagttttgagcagtaggtatcagctgactgagatcagaaaaaggatttct

SEQ ID NO: 80343 - DNA, 201 bp, Homo sapiens
ttagcccggcacaggggtatgcacctgtcgtcccagctacttgggaggctgagttgtgaggattgcttgagccagggaggcagaggctgcagtgagcctasattgcactgctgcactccagcctgggtgacagagtgagaccccatctcaaaaaaaaaaaaaaaaaaaagattaaaggctttaaaaaagaataaaagacat

SEQ ID NO: 80344 - DNA, 201 bp, Homo sapiens; identical to SEQ ID NO: 5511

SEQ ID NO: 80345 - DNA, 201 bp, Homo sapiens; identical to SEQ ID NO: 29743

SEQ ID NO: 80346 - DNA, 201 bp, Homo sapiens
ggaggctgagccaggagattggcatgaacccaggaggcggagcttgcagtgagccgagattgcgccactgcactccagcctgggcgacagagagagactcygtctcaaaaaaaaaaaaaaaaaaagaaaggaaaagaaattagaaccttgggccaggcgcggtggctcacgcctgtaatcccagcactttgggaggctgag

SEQ ID NO: 80347 - DNA, 201 bp, Homo sapiens
cggtggctcacgcctgtaatcccagcactttgggaggccgaggcgggcagatcatgaggtcaggagattgagaccatcccggctaacacggtgaaaccccrtctctcctaaaaaaaaaaatacaaaaaattagccggggagggtggtgggcgcctgcagtcccagctactcgggaggctgagccaggagattggcatgaac

SEQ ID NO: 80348 - DNA, 201 bp, Homo sapiens; identical to SEQ ID NO: 29745

SEQ ID NO: 80349 - DNA, 201 bp, Homo sapiens; identical to SEQ ID NO: 29746

SEQ ID NO: 80350 - DNA, 201 bp, Homo sapiens; identical to SEQ ID NO: 29748

SEQ ID NO: 80351 - DNA, 201 bp, Homo sapiens
gtgctgggattacaggcgtgagccaccacgcctggccgagcattgggaattttaaaagctctctggatgatttcaactctgggtgaatcacactttgcagratttgattcagtgggtcgcggtaggtcgagcctgagaatttgcattctaacaagtttccaggtgatgcttatgctgctggtctggggactgagctttgag

SEQ ID NO: 80352 - DNA, 201 bp, Homo sapiens
ttttttttttgagatggggtctccctctgtcgcccaggctggagtgcagtggcacgatcttggctcactgcaagctccacttcccggattcacgccattcscctgcctcagcctcctgagtagctgggactacaggcacccgccaccacgcccggctaattttttgtgtttttagtaaagacggggtttcaccatgttagc

SEQ ID NO: 80353 - DNA, 201 bp, Homo sapiens
gaaccccacccctagagtttctgatggaatttaggtgtggcctgaacactgggattttttttttttttttttttttttttttgagatggggtctccctctstcgcccaggctggagtgcagtggcacgatcttggctcactgcaagctccacttcccggattcacgccattcgcctgcctcagcctcctgagtagctggga

SEQ ID NO: 80354 - DNA, 201 bp, Homo sapiens
tggggaacttgttaaaacaaagattgctgaaccccacccctagagtttctgatggaatttaggtgtggcctgaacactgggattttttttttttttttttytttttttttgagatggggtctccctctgtcgcccaggctggagtgcagtggcacgatcttggctcactgcaagctccacttcccggattcacgccattcg

SEQ ID NO: 80355 - DNA, 201 bp, Homo sapiens
tattcaccaccacgcccagctaatttttttgtatttttagtagagacggggtttcatcatgttggctaggctggtctggcactcctggcctcacgggatcygcgcacctcagcctcccaaagtgctgggattacaggcacgagccaccacgcctagcccagtttttttttttttttctccgagacagagtctcactatgtc

SEQ ID NO: 80356 - DNA, 201 bp, Homo sapiens
aggagaaaccaagtctgccaggagaaatatgaatttggaccttggagaatgaaaattgtaggaaaagtaggcagggtagatgggcagggaaacccaaagcrtggtcagggcatcttctgaggatgatggggatcctgcaactaagccagccaaacttgagtctagaattgtgtgcccccaggtgcccttgagcccagggta

SEQ ID NO: 80357 - DNA, 201 bp, Homo sapiens
cagccatctctgtttcagatctgtgccttcctctacctctcctgtgccgtctgccagcccactcctgaagacctgagatggctgggtcctctgtcttagtktctctctgcatattgtcgcatctccatctacttttcaagaatgttatttccctttaaaaactaacacatgaggccgggcgtggtggctcacgcctgtaat

SEQ ID NO: 80358 - DNA, 201 bp, Homo sapiens
aaggactgtgccatgccagagagagagagagattgtgtgtgtgtgtgtgtgtgtgtgtgtgtgtgtgtgtgtgtgtgtgtgttggggaagtactgtttggkttgggttttttgcactgacatgagaaagaatggggtgctgggtaatctttttcagggttgagagacgctataatgaaggaaagctcagcatccttgagtt

SEQ ID NO: 80359 - DNA, 201 bp, Homo sapiens
attgggtgccagctccttggccactagagcagtgattctcagttgcgggagggaagattctctccctcagccccaggagacatttggcaaaatctggagayatttctgatgatctatatgggagtgcatcggcatttagtattatagttagaggccaaagatgttgttaaactttccaggacagcccaccacccccaataa

SEQ ID NO: 80360 - DNA, 201 bp, Homo sapiens
attgatgccattcatcaccatttcaatgtgttacattccagtgggcatcccccaggagggaggtggctggaccagcctgtgtacacatcttcgctatgggmtgaagcccagccacgacacactggtcaggagctgggccttgcagagccagttaaatgtagcctagactgggcatggagaaaccagcagttttaacctgcc

SEQ ID NO: 80361 - DNA, 201 bp, Homo sapiens
cccatgagtgaaatgggctcctgtgtggcggcttcccaccacagtgacaatgacattattcaaaatgctctccttgtcctcttagaagctctatgtaacasgaacctatactataaccgtattataaatgaaaaatgtgaagaagcgatccgtgtctccccgtctccattctgccacagttgcagtcgtttctttcctgga

SEQ ID NO: 80362 - DNA, 201 bp, Homo sapiens
tccatggctctttccacagctgaggagccaaagtctcaggcaggtctcaaagctggcaagtttaaactaagtgatatttagtctgggtgggatactgatcrtgcatttttctttcttttttcttgctctaaagggcattattagggccgggtgcagtggctcatgcctgtaatcttagcactttgggaggccaaggtggca

SEQ ID NO: 80363 - DNA, 201 bp, Homo sapiens
agaatggttggaatttagtcacaggaagcaaggaaggagatgttgagagatgggctagggaggtaacagagaccagccctcaaagtccttctttatcattyttagaaatttgaaccttaggctgggctcggtggctcacgcctgtaatcccagcactttgggaggccgaggcgggcagatcatgaggtcaggagattgaga

SEQ ID NO: 80364 - DNA, 201 bp, Homo sapiens
gtggtgtgatctcggttcactgcaacctccgcctcctgggttcaagtgattcttctgcctcagcctcccaagaaggtgggactacaggcacacgccaccaygcccagctaatttttgtatttttagtaagagacggggtttcaccatgttggccaggctggtcttgaactcttgacctcgaatgatttgcccacctcggcc

SEQ ID NO: 80365 - DNA, 201 bp, Homo sapiens
aaaaaaagaggtggggagctctagattaatatgggaaaatgataagctattcaatctggtgtccattagtgtctctacttactttctgtacttaaaaaaawatatatatatatgtatatatattttttgagatggagtctcactgtcacccaggctggagtacagtggcgcaatgtcagctcactgcaacctcctcccagg

SEQ ID NO: 80366 - DNA, 201 bp, Homo sapiens
tggactcatgtgcagatagattgttgtgtgcatctacactcccggcctgttcatagaagacttccggggcagcaagcagaaatgcttgtcagcccacattstttttttttttttttcaatacagagtctctgttacccagtctggagtacagtggtgtaatcttggctcgctgcagcctctgcctcccaggttcaagcgat

SEQ ID NO: 80367 - DNA, 201 bp, Homo sapiens
agagtgcagtgatgggatcatggctcactgcagcctcaacctcccaggctcaggagatcctctcactgcagcctcccgagtagctgggactagaggggcaygccaccacccccggccaatttttgtattttttgtagagatggggtctcgccatgttgcccagactggtctcataatcctgggctcaagccatcctcctgc

SEQ ID NO: 80368 - DNA, 201 bp, Homo sapiens
ctggcctaactaatctttttttttttttttttaagtgcactgcactgaagtgcagtggtgtgatcacagctcattgcaaccttgaactcctgggctcaagygatcctcctgcctcagcctcccgagtaagtgggatacaggcatgcactaccatccttggctaattttttttaaattttttgtagagaaatttttgtttct

SEQ ID NO: 80369 - DNA, 201 bp, Homo sapiens
gaaaatacattgctgggtccccacctccagaggaaaggtcctgagaatctgcattgccaacaagttctcagaggatgccgatgctgctggtccagggagcrcactgagaatccccgctctagggcttcgtggttcctcactagagcttctgcttcaaggggtgagagagcagaagtcagacacaatggccccacttcactc

SEQ ID NO: 80370 - DNA, 201 bp, Homo sapiens; identical to SEQ ID NO: 29734

SEQ ID NO: 80371 - DNA, 201 bp, Homo sapiens
ggtccccacctccagaggaaaggtcctgagaatctgcattgccaacaagttctcagaggatgccgatgctgctggtccagggagcgcactgagaatccccrctctagggcttcgtggttcctcactagagcttctgcttcaaggggtgagagagcagaagtcagacacaatggccccacttcactccaaggaagcctgaga

SEQ ID NO: 80372 - DNA, 201 bp, Homo sapiens; identical to SEQ ID NO: 29735

SEQ ID NO: 80373 - DNA, 201 bp, Homo sapiens
agtttcgctcttgttgcccaggctggagtgcaatggcacgatctcggctcactgcaacctccgtctcctgggttcaagcgattctcctgcctcagcctccygagtagctgggactacaggcgcctgccaccacgcctggctaatttttttgtatttttagtagagacgggatttcactgtgttagccaggatggtcttgat

SEQ ID NO: 80374 - DNA, 201 bp, Homo sapiens; identical to SEQ ID NO: 29736

SEQ ID NO: 80375 - DNA, 201 bp, Homo sapiens
tgagcccaggaggtggaggttgcagtgatctatgattgcgccactgcactccagcctggacgacagagtgagactccatctcaaaaaaaaaaaaaaaaaawaatacctcaagaaagaatctaacctaccctcaggtaaaacaaaaaatgtgtttgggatttagtgccatccacaaagttaagcaaaggcataaatgactca

SEQ ID NO: 80376 - DNA, 201 bp, Homo sapiens
gatgaagtaaaatattcccattttaaagatgagacgatggagtccagaaaggttagaaagagcctggaaccctgatctcttgcctcctgtgctctaaaacraaagcttggcttctgcgggggagccagtttttaaaaacaaaccttaggtcaaatctaggaggcaaaattgccaggttctttggaatgcgaggggaagaga

SEQ ID NO: 80377 - DNA, 201 bp, Homo sapiens
cttgtaagtggggttcagctaggacccctgattccgtatttgttgaacacctcaacacggtcggcactcccagtgccctctgtgtttagacaaacagctgmatttgatttttccttccaaaggagaccatctagtccaggcccctgcttcaggctgatgaagtaaaatattcccattttaaagatgagacgatggagtcca

SEQ ID NO: 80378 - DNA, 201 bp, Homo sapiens
ttgcgtggtcactttatgtttaaccatttgaggagccgccagcctgttttccaaaatggctacaccattttacattgccatcagcagtgtatgagggttcyggtttctctacatcctcatcaacacttggcattattttctgtccttttgactatagctatcctaatggatgtgaagtggtatgtcattgtagtttggttt

SEQ ID NO: 80379 - DNA, 201 bp, Homo sapiens
taattatttttctttgaattgattcacttttttccactttttaaaaatggagcttcactgtaagcaacagtatccaagatatcaaactttgcctgtaacaygcatgtgtaattgtgtatacgtatatacatgtgtatacacatacataaaaaatacacatacatatgtatttataattttgtttgtttggctatatataca

SEQ ID NO: 80380 - DNA, 201 bp, Homo sapiens
taccattctaatagaaaccagtgatgcctgccacttatttgagtgtatatggctcatttcccatcctccttataagctctggattctgggctgggcacagkggctcacacctataatcccaacactttgcggcccaaggtgggaggatctcttgaggctaggagttcaagaccaggctgggcaacagagtgagaccctgtc

SEQ ID NO: 80381 - DNA, 201 bp, Homo sapiens
tttttcctgcccattcttccttctttgaagggaaaaatggaaattgaagaggaagaaatcaatgacccatttgaaccatgacttggagtttaattcagcgygtatctgagtgactacgtgagtactcctgacctccaggaatggatagaatggaatatggaaaatcaaggtggatcaaatgagaatttggccagtggactt

SEQ ID NO: 80382 - DNA, 201 bp, Homo sapiens
atttctcattagtatctttgtggtttgcagtcacctgtgtagaatttgcacatatactcaagtgttatttgttttcaattacttcctcaattattgctggkgtgtgtgtgtgtgtgtgtgtgtgtgtgtgtgtgtgtgtgtgtgtgtggtatttcatagccaaagctataaaatgtatttccaataatattagtagaattt

SEQ ID NO: 80383 - DNA, 201 bp, Homo sapiens
aagatacatctgttatttgaaaacgctttatgagactgtactcatgtattgtgtaaaaaattagaaaaggcatatctgcttgttataaagttcatagaaascagaaaactatctcctttcacttatcctttcccagaaatagtcattgataataatttgcatcttctcagatttttttctacgcagaaataaatgtgtata

SEQ ID NO: 80384 - DNA, 201 bp, Homo sapiens
catgtgtaagcgtatgggcttgcatctatgttcttgtcccaaaccctgcagatattggggttgggggggctgtctgcatgcccttccttccccagtgggtraccatcactgacccctgagacttaagacaaattgtagccatgcccgcctccgaaggcgtctttaggaaaacagtgtcgtaggtcctttcagttcaaaacc

SEQ ID NO: 80385 - DNA, 201 bp, Homo sapiens
tcttctgaattataaaacctttcaaaaggagcacaggtttattgcttctgaacttcaccaggaattgaagccagactggcaagggggctccctggacgaartcctctgtgtgtcccttgtaggtcagtggtgctttttcctgcattgggggggcttgaaggttgtttcatagccatttagatattccccttggagtcttgc

SEQ ID NO: 80386 - DNA, 201 bp, Homo sapiens; identical to SEQ ID NO: 29740

SEQ ID NO: 80387 - DNA, 201 bp, Homo sapiens; identical to SEQ ID NO: 29741

SEQ ID NO: 80388 - DNA, 201 bp, Homo sapiens; identical to SEQ ID NO: 5508

SEQ ID NO: 80389 - DNA, 201 bp, Homo sapiens; identical to SEQ ID NO: 5509

SEQ ID NO: 80390 - DNA, 201 bp, Homo sapiens; identical to SEQ ID NO: 5510

SEQ ID NO: 80391 - DNA, 201 bp, Homo sapiens; identical to SEQ ID NO: 29758

SEQ ID NO: 80392 - DNA, 201 bp, Homo sapiens; identical to SEQ ID NO: 29759

SEQ ID NO: 80393 - DNA, 201 bp, Homo sapiens
ggtatgccatggtggaatttcacaaagagcacacccgcacgctgcctctgagagcaacttccagaatcaagacaccgtctcttaaaagaaaaaaaaaaaaactaaaaagaataagatgtaggcttagggcttcctcccctgaggaattcttttggatccctctggcctctgacaagccaagcagaatatggagaaaggagt

SEQ ID NO: 80394 - DNA, 201 bp, Homo sapiens
catgggctctggcactgaagcattttgaggacagatgctccccgacttaggatggagccgcgtcctgataaacccgtcgtacattgaaaacacaactttcmccttagaatatttgcaacatatgatggttttatccagacataaccccatctaggtcaaggagagtactgaattaatatcgtttttgcaccatcgtaaagt

SEQ ID NO: 80395 - DNA, 201 bp, Homo sapiens
cctcctcacgggctcccacggctgtgatctgaattatctctccacactctccctgagggatcgagagcagtaaagggcaacgtcctgtcttctctctgatytgggagcccctgagaagccagcattcttctctcccagcttacctcttcctttggctgtattttccagggtaagaaaaagaagaggaagagagaaaagcag

SEQ ID NO: 80396 - DNA, 201 bp, Homo sapiens
ggctgtccgcatgtttgtcttagcaaccacgccatttctgaccacgaaacagctttttcttgccagttaatgagcaggcacagggctcaccctccccccamctctctttgatcaagcatcttctcacgtcccgcgctccccacccccaggtcagaatggagaccacaggatcactgtccccatctctccaacagaaggatt

SEQ ID NO: 80397 - DNA, 201 bp, Homo sapiens
cttttagcatgatccgacccagttgttttcttgactttgttttagaatgaatctcttccgcatcatctaataacaaggttcgtgtactcattaaaaccaawgatacagccttctgtccgcatattcacttgctcatagagccacacctgaatctgcgatctattttgtaagtatctgaagatgaggttgatgggcgcatct

SEQ ID NO: 80398 - DNA, 201 bp, Homo sapiens
ttttcttttttttttttttaacttgcccaccagacctgtccattccagggagccactgtctttatagcattcacacagagttgccaggggaaggcaaagcrtttttggagcccctctttggagaaataacagtcactacaagttacagataatgaggaagacacatgtggaggaggaatccaaagtttatttctccatgaa

SEQ ID NO: 80399 - DNA, 201 bp, Homo sapiens; identical to SEQ ID NO: 29764

SEQ ID NO: 80400 - DNA, 201 bp, Homo sapiens
tgcatcctatttcagaaggtttatcttcttaaagactgatataattttcacattttactttaaacagtaaatacaagtgtaggaggccagaaagcaacagstaagttagaccctagtccgtaaattccaatcccttataagaaggaatctcttccaatgagaccttttgtttttcctgccccaaggtgaatgttttgagaa

SEQ ID NO: 80401 - DNA, 201 bp, Homo sapiens
tagcagaggaatacctccttttagcatgatccgacccagttgttttcttgactttgttttagaatgaatctcttccgcatcatctaataacaaggttcgtrtactcattaaaaccaatgatacagccttctgtccgcatattcacttgctcatagagccacacctgaatctgcgatctattttgtaagtatctgaagatga

SEQ ID NO: 80402 - DNA, 201 bp, Homo sapiens
tcttggttaacatgtgcaggattggtaggcattcagccccaattattccgcccttaactcatttttgcagtttattaataatcagttggcacgcagtttcraaagaactaattctgtaataacatgttatggctactcctcggcgccattacatgcctgaggtcccttgctgtccctttgtgtttttgatgaaaggtaaca

SEQ ID NO: 80403 - DNA, 201 bp, Homo sapiens
gttgactgactcattgagtctagaggatgggagcaggggaacagcagggaagagcctctttgcactctttgatccagaggactggatgcactttgtttttkttttttttttttttttttttttttttttgagatggagtttcactcttgttgcttaggtgaatgcaatggcaccatcttggctcactgcaacctctgcctc

SEQ ID NO: 80404 - DNA, 201 bp, Homo sapiens
gtgccttttgtttttgtttttaaggaaatggagaaaggaaggaagctggagggtttaaattcattatgctagctttagattctgcaaaatcaggaaatcaraaagtacaagttctcagagttagtgacatttaactcaattgggaagggcccgcccaaggtcacccttttaaagggtttgtcttccttttcaacatttttt

SEQ ID NO: 80405 - DNA, 201 bp, Homo sapiens
tgtgcaaactcatcacagtgtggactgtttctcctctatgtgcaaactcttcccaacccatcatgccctggaagatgccatgcccccaaacgcagtgggascagtggatttggcccaggtctgtccctggcctgctggatgactttgcaccaatctctccagggtggtactgtccaataaaaatgaaatataagctgaagc

SEQ ID NO: 80406 - DNA, 201 bp, Homo sapiens
gcagctgtgtaaacagtggggttggggggtgggttgcaaagctaaggataatgggggagggaggaggggcatgaagaaggagggagggggctggtgggggsctgccaaatcaggcagggtcagggaggagagggtaagaacaggaggcctaaagcggggttcgcgggctccctggctcttcacatatggaggacatgcctc

SEQ ID NO: 80407 - DNA, 201 bp, Homo sapiens; identical to SEQ ID NO: 29768

SEQ ID NO: 80408 - DNA, 201 bp, Homo sapiens
caggcacacaccaccacgcctggctaatttttgtatttttagtagagatagggtttcaccatgttggccaggatggtctcgatctcctgacctcgtgatcygcccgcctcagcctcccaaagtactgggattaccagcgtgagccactgcactcagccagagaattatttttaacatgctataaaattaacttttggggtt

SEQ ID NO: 80409 - DNA, 201 bp, Homo sapiens
ttgtgttctctaaaaaggttaaattcagagattttttttttttttttttagatggagtctcgctctgttgccaggctggaatgcaatggcgtgatctcggytcactgcaacctccgattctctggttcaagtgattctcctgcctcagtctcctgagtagctgggattacaggcacacaccaccacgcctggctaattttt

SEQ ID NO: 80410 - DNA, 201 bp, Homo sapiens; identical to SEQ ID NO: 29771

SEQ ID NO: 80411 - DNA, 201 bp, Homo sapiens
aaatgcagtaaagcacggggcctggctccataggcagtgtgtggggtggctctgcccaagtctagcccagctgtgggccgtgcttccctacaccaagacaygtttgccctaaactgaacatttttaaatagattcatcagtctaagcagacacagaagtgcaaccgtaaagcagtgaggccaaactggcttttatttattt

SEQ ID NO: 80412 - DNA, 201 bp, Homo sapiens
gtccatgtgggttagaaatctggaagggcattttccatggagcgagcctttagccaagctctaaaggccaggtaggatttgggtgagcaggaggagaggaygctgcagtcagcagatgggcagtgaggcggggaagaaaggcggaaccaggcctggtatcagagctggggctggcaggggagaggcagtgttcgggaaagt

SEQ ID NO: 80413 - DNA, 201 bp, Homo sapiens
tccaggaaggaaagctaggcctaagttctctcctcttctcagtggagtgaggttgttttttgtcttggggtatgtaggcaccagaactgttcacacagttyggcagatttcatgttaaggaaatgactttgggaagaaaaggaggtgtccatgtgggttagaaatctggaagggcattttccatggagcgagcctttagcc

SEQ ID NO: 80414 - DNA, 201 bp, Homo sapiens
gcaggaaccggcaccccccagcctgagccctgcagtgagcgtgtaagtaagcggcagcctggattcaggtgggagggtgcaggctgtggggaggggtggcsacactctgagcagcaaatgtcatgtactcttctctcttggtgtcactcagcaggcatcacagcctccccagccaggccctccctcttcctcgggacttac

SEQ ID NO: 80415 - DNA, 201 bp, Homo sapiens
gtcagcaagtttatgtctgtgccgagcattctggaggatgtaagagaacatgactccaggctgtttggagaggcaaaagcaacccaaataaagtaagtgargacttagtgcagactgcaagtgtattagccagaggtggcattacagagcccagctcaggatacggaatggctccagcaactctgtactgctcaacccact

SEQ ID NO: 80416 - DNA, 201 bp, Homo sapiens
catctctacaaaaaatacaaaagttagcccggcatggtgggaagatcccgtgagcccaggaggcagaagctgcagtgagctgaggtcacaccactacactycagcctggggggacacagtgagactgtgtctccaaaaaaaagtcattttctcattgacaccttccctggtcatcctgggaaacatcctgtttaacctgct

SEQ ID NO: 80417 - DNA, 201 bp, Homo sapiens
ggcagtaggtgttttatattcagaatcttagccatggtgaataagcatgtcatatatagttcagccctgattttggggaaaatcatcgggcgagtcagcargtttatgtctgtgccgagcattctggaggatgtaagagaacatgactccaggctgtttggagaggcaaaagcaacccaaataaagtaagtgaggacttag

SEQ ID NO: 80418 - DNA, 201 bp, Homo sapiens
agaatgtcccttagtttgggtttgtctgatgtttcatcatggttagattcagattgtgcatttttggccagaatgtcactgcactaaagttgcatcctcgktacctcatttcaggaggtagccctacagtctgcctttgtcccagtattagtgatgttagcatcaactgtttggattaggtggtatctgacaaacgtttcc

SEQ ID NO: 80419 - DNA, 201 bp, Homo sapiens
tagcacagagggaatgtattccttgtctaacttggcatatagccaaaagctaggtgtaagttagtaaactacagccttcaaaacagcccctgggaaaggcyctgctttggagggtagaaggacatataggaggctcccagaggtacgggtgtgcctccctgctgggcatgggcccgcctgctgggggcagcagcaaaagga

SEQ ID NO: 80420 - DNA, 201 bp, Homo sapiens
ccttagcctgtctttgtctttcttgaccttcacattttttgagaagtacaggccagctgttttgtagaatgtcccttagtttgggtttgtctgatgtttcrtcatggttagattcagattgtgcatttttggccagaatgtcactgcactaaagttgcatcctcggtacctcatttcaggaggtagccctacagtctgcct

SEQ ID NO: 80421 - DNA, 201 bp, Homo sapiens
ggagagttataagagaaagaggtgcggagagcagggagcacctgagagagggctggaagaagtggtaaatagatggacctgcccaatgagagtagccagcrtgtgcatgtgaggggcaggtagcacagagggaatgtattccttgtctaacttggcatatagccaaaagctaggtgtaagttagtaaactacagccttcaa

SEQ ID NO: 80422 - DNA, 201 bp, Homo sapiens
agacctaagaggccagctgccctgtgacccctcctgagttggggcttctttttgggggattagggaggagagttataagagaaagaggtgcggagagcagrgagcacctgagagagggctggaagaagtggtaaatagatggacctgcccaatgagagtagccagcgtgtgcatgtgaggggcaggtagcacagagggaat

SEQ ID NO: 80423 - DNA, 201 bp, Homo sapiens
acactggcagcatcttccttatcatccggttggtgggtctcttgagcaggcatcggagtcatctggggaacttgttaaaacaaagattgctgaaccccacmcctagagtttctgatggaatttaggtgtggcctgaacactgggattttttttttttttttttttttttttttgagatggggtctccctctgtcgcccagg

SEQ ID NO: 80424 - DNA, 201 bp, Homo sapiens
agcactggagacaggcaggaggcagaaaaacagaaacagcaccatggggggatatatagaagcactctgcggggaggaggggcgcatgattttgattacascacagggtacctattgattgaattattaataaagattaaattgaatcacacatatcctatatatgaaggcaggggaatcgcaaatacatttatgccagtt

SEQ ID NO: 80425 - DNA, 201 bp, Homo sapiens
aatcacttgaacctgggaagcagagtttgcactgagctgagatcgcaccattgcactccagcctgggtgacagagtgagactctgtcttaaaaaaaaaaaattacatattaaaaattcactagagcctgggcaacgtagtgagacccccatctctacaaaagttttaagaattagctggctgtagtggcacatgcctgtgg

SEQ ID NO: 80426 - DNA, 201 bp, Homo sapiens
ggtctcgctatgttgctcaggctggccttgcactcctggcctcaagtgatccgcctgcctcagtctccaaaagtgctaggattacaggcatgagccatcaygcccaacctccccatttttaagatataatttacatatagtgaaattcacatgagtatatagttctgtgagttttgacaaacttttgcagtcatacatgag

SEQ ID NO: 80427 - DNA, 201 bp, Homo sapiens
aagacatcagagattaggtgattaggtagaagcttttgaacaagcccagccttaaatctgccctccagtcctgttagatccttcttgggaagctggtcccygtccctggccagtcagtctcaagtgagtggggctgagaggagctgcaggcaaaataaatacccactccttccagagttacttgccttgagacgtgacctt

SEQ ID NO: 80428 - DNA, 201 bp, Homo sapiens
ttattaaacaccagcttcactcgagcagtggttcccaaattttcttggtctgtgaagacgtattttctctatttttagccaaacagaatgattttagtccrtcatgggtcaaaccttctgatattctttagtccccatggaagacattcttgtttctcctttaagaccatctctggggtcaccttcggttgccttgggggt

SEQ ID NO: 80429 - DNA, 201 bp, Homo sapiens
ccagcaacccgtgcctcctcccagactctgcaatcctgtgggtgctccataaatacttgttgactgacttgactcattcccttggggagggaaaaaaaaaacaggaggaagtagggaaagggggagtgaacttggttttccgtctctcgtaagtatcataaggaaatacctagcctaatgtctgttggcagactatgactg

SEQ ID NO: 80430 - DNA, 201 bp, Homo sapiens
aatctaattccattgaaaagtgaatcatcctacctgagggttaatggaatgaggttgaaattgtctttgaaatacccttaggaaggcagcacatgagcccytgacatcccacctgtcagtggatccaggggagcccgggtttccttggatgtttctttggttgaacaccagaaaaaattagtttgcttgggtttaggaggc

SEQ ID NO: 80431 - DNA, 201 bp, Homo sapiens
atcttgactactgggaccctttcatctcatccaacatatttgagggatctcctgtgggccaggcactgatcctagtgctggaagtccagagataatgcctsccttcaaagagtttctagttcaataaagagagcctcatttaatcaaaagtgttgcacatactataattttaggagaaaattaatcccaggaaacaaacgt

SEQ ID NO: 80432 - DNA, 201 bp, Homo sapiens; identical to SEQ ID NO: 29750

SEQ ID NO: 80433 - DNA, 201 bp, Homo sapiens
tctggcggccgagcgcgaggctgcgctggccagtgcctggatgaaagtaaagttactttaacttttcccctcttgcgggttgaggttttggagtccacctmtgggatcttccttggcctccagaattcttcgcctgcaccgaaggaaacttggatttgtgcccgctttgggggggtctcgctttccttcttggaaatcggt

SEQ ID NO: 80434 - DNA, 201 bp, Homo sapiens
gaagagactctgactgagagagaggggaatggggagtgggactacacagacctcacagttttgccccgagagggagggaggtctcttgcagctttggccckgctggcctggagcaccccaggaagtcctgaatgtaagtgtcagttttgcagtgaaaactggatgtgggtctatggctgttgctttttctcattaaaagaa

SEQ ID NO: 80435 - DNA, 201 bp, Homo sapiens
agcatgctggactccccggccactccctctgcagctttggcctcaccagctgcccctgctgccacccattcggagcaagcccagcccctctccctcaccamcaaaccagaaacccgggcccagctggctctccactctgccgccttcctgtcggctaaggctgcagcctcctcctctgggcagatgggcagccagcctccc

SEQ ID NO: 80436 - DNA, 201 bp, Homo sapiens
ggctcatgcctgtaatcccaacactttgggaggccaaggcgggcagattgcttgagctcacgagttcgagagcagcctgggcaatatggcgaaaccccatygctacaaaacatacacaaacttagctgggcatggtggtgggcaccagcttcttggaaggctgaggtgggaggatcacttgagcctgggcatggaggttgt

SEQ ID NO: 80437 - DNA, 201 bp, Homo sapiens
caccccttattaaacaccagcttcactcgagcagtggttcccaaattttcttggtctgtgaagacgtattttctctatttttagccaaacagaatgatttyagtccatcatgggtcaaaccttctgatattctttagtccccatggaagacattcttgtttctcctttaagaccatctctggggtcaccttcggttgcctt

SEQ ID NO: 80438 - DNA, 201 bp, Homo sapiens
tccaaattcccttgtgtttttcttatgatattttgaggtggtacacttggttccttaaatatcataggtgagatgttaacagttctaggtggagatacacrggcaatcaatctattcacccaacttctctgtatgtttggaaaagttcggaattaaaaacccaggataaataaactaaggcctatttcttcagccacattc

SEQ ID NO: 80439 - DNA, 201 bp, Homo sapiens
tttcatcatgttggctaggctggtctggcactcctggcctcacgggatccgcgcacctcagcctcccaaagtgctgggattacaggcacgagccaccacgsctagcccagtttttttttttttttctccgagacagagtctcactatgtcgcccaggctggagtgcagtggtgcgatctcagctcactgcaactttcacac

SEQ ID NO: 80440 - DNA, 201 bp, Homo sapiens
tgagcccggcacagtggctcacacctgtaatcccagcattttaggagaccaaggtggatggattgcttgagcgcaggagttcgagaacagcctgggcaacrtggtgaaaccgcgtctctacaaaatattagcgaggtgtggcagtgcgcatctgtagtcccagctacttgggaggctgaggtgggaggattgcttgagcct

SEQ ID NO: 80441 - DNA, 201 bp, Homo sapiens; identical to SEQ ID NO: 29760

SEQ ID NO: 80442 - DNA, 201 bp, Homo sapiens
ggagtcaggcaaggatgacagtggaaggaaccgtgagtgcgggaccagccatccgggaaaggcagcaggttctgcagccagtcgccaaggcacaagctgcygttgaacaagcactccacacctcaggcataagccagggtagtggctttggcccagagtcccacttgggatagccaagcacgaggcgcgggtgccctctag

SEQ ID NO: 80443 - DNA, 201 bp, Homo sapiens
cacatgagcaatcaggatttgctaatactatcaccagtttttaagacagctataaatgatgtaaataaatgtaaatttaaaactgatgcagaggctgggcrtggtggctcacacctgtaatcccagcactttgggaggctgaggcagggggatcgcctgatgtcaggagttcaaaaccagcctggccaacatggtgaaacc

SEQ ID NO: 80444 - DNA, 201 bp, Homo sapiens
tccctctttggaacttctgtgttccgtcttcgtgataattgttcatttttacttcagtgagccaagtgggtaggtatgtacgtctatggtctcatgtcggwgagcacaagcctcattcaccaagctctgctgaactaggaaaatagtacattgagaagtctggtcaaatccactaagtcaaagggatttgcacatttggca

SEQ ID NO: 80445 - DNA, 201 bp, Homo sapiens
tagtaggttctttgaatatgttgattggttgtgctggaatggatcggttctctccaccacttaaagttcagcttagttgtcattcgtgtccccccccccaraatgacatagggcgtggtgaggctggtagtgattgtaaatatatgctcgctcctgttataatcgtttggaaattgacccagtacagggcatgtggcatga

SEQ ID NO: 80446 - DNA, 201 bp, Homo sapiens
taaattagccaggcatggtggcacatgcctgtggtcccagctacttgagaggctgagatgggaggattgcctgagcccaggaggtggaggttgcagtgatytatgattgcgccactgcactccagcctggacgacagagtgagactccatctcaaaaaaaaaaaaaaaaaaaaatacctcaagaaagaatctaacctaccc

SEQ ID NO: 80447 - DNA, 201 bp, Homo sapiens
aattgaggctgtacatcctttaaaaataaataaagccgaggtctgtgctagagttagaacattgaatctggctcgctggtttgtgctatggactttccttyatctgtgttactgggagtatgtgagcagttgtagaggccatatcgttttataggcctgtgccaaggaaaatacttgagaattacattagcaactccaagg

SEQ ID NO: 80448 - DNA, 201 bp, Homo sapiens
caattcgtcccagaattgaggctgtacatcctttaaaaataaataaagccgaggtctgtgctagagttagaacattgaatctggctcgctggtttgtgctrtggactttccttcatctgtgttactgggagtatgtgagcagttgtagaggccatatcgttttataggcctgtgccaaggaaaatacttgagaattacatt

SEQ ID NO: 80449 - DNA, 201 bp, Homo sapiens
agtgatggaaatggatggggcaggatggccatctgggagcctctgcctccttggtcagccctgcgtgtccatgactacagcatagggaggggacttgagcstcactagtaggttctttgaatatgttgattggttgtgctggaatggatcggttctctccaccacttaaagttcagcttagttgtcattcgtgtccccccc

SEQ ID NO: 80450 - DNA, 201 bp, Homo sapiens
catgagttggctgtgtccctatgccccagggcccccctcagggagaatggggataatgatagtcataatgataaatggggacagataatgctttgagaagyactgaagtaacattttgtctgaatggactgtgttttaaaatcaggagttgttcgaggctgaaatgaaatatcagcatcatagaatctccaggatataaaa

SEQ ID NO: 80451 - DNA, 201 bp, Homo sapiens
atggatattgccaccagcatttattaataacagatgagccaagtgctcagcagaattgcaatcctaaggactctcaagcatttctctcaagatatttttttcttatctcatgaaatcatgcagtctagtcattatctgatacatgtacccccatgatggttttgaccaccaccctccttccctcttgtccacttgtaggac

SEQ ID NO: 80452 - DNA, 201 bp, Homo sapiens
tatgcccgggcctctgaccctcctccccttttgtgtgtttcatcccacctgcttccagcaccagatgggcagcctgggtgttggtggggagaaggaagagscattaagcatctcccaaacctggttttctagaagacgacaaatagccttctagtcctgagactctgccccacggacatgcctgtgcccttaaggcagaga

SEQ ID NO: 80453 - DNA, 201 bp, Homo sapiens
ccagatccagaaagtggctgatgtcacagttaattcctggtgtccaagctcaggcacctggagactgacttctgtgggtggggaggcctccccagtctctrcctccccagtggtggacagatgcttactgaatattttggcgatgacagagcccacacagtctatgagaggctctcattgggaggaaccctcggtttcatt

SEQ ID NO: 80454 - DNA, 201 bp, Homo sapiens
aggaggcgttccattcccgtagctattctgtatcaaccgctggggtcagaggctctcagctggagtccacccacagacagaattcagggaagctccaaaawcctgaatggaaagaaattacattttattttcactaactgaaaattggcattttcttcaattatgaatgtagactataaaccacagggacattaacagttc

SEQ ID NO: 80455 - DNA, 201 bp, Homo sapiens
gaaaagttcagggcgatttgggggtaatgcagcttatttcagttccatttgcctggaaggagaaggggccaggacatgggctaggggacctagaatgccakggaaggaatctgatcttatttaagaggcagcagagaaccatcagaagttaggctgggaagtgatgtgacttgtacacatggctagaaagataatggtgga

SEQ ID NO: 80456 - DNA, 201 bp, Homo sapiens
tctttctaggctcttggcaaggactgtgccatgccagagagagagagagattgtgtgtgtgtgtgtgtgtgtgtgtgtgtgtgtgtgtgtgtgtgtgtgttggggaagtactgtttggtttgggttttttgcactgacatgagaaagaatggggtgctgggtaatctttttcagggttgagagacgctataatgaaggaaa

SEQ ID NO: 80457 - DNA, 201 bp, Homo sapiens
tttgcaacatatgatggttttatccagacataaccccatctaggtcaaggagagtactgaattaatatcgtttttgcaccatcgtaaagtcaaaatatccyaagtcacggactgtctgtatatcacactgaagctagggactgggagaagatgaatttttcctgaaatgatgtcaggagaggagacggtgaaaggggattt

SEQ ID NO: 80458 - DNA, 201 bp, Homo sapiens
tacaaaaaaattagccggacatggtggtgggtgcctgtaatcccagctacttgggaggttgaggcaggagaatcgcttgaacccaggaggcagaggttgcagtgaaccgagatcacaccacttgcactccagcctgggtgacagagcaagactctgtctcaaaatagaataaaattttattttgagccactgagcccggca

SEQ ID NO: 80459 - DNA, 201 bp, Homo sapiens
gatgggctagggaggtaacagagaccagccctcaaagtccttctttatcattcttagaaatttgaaccttaggctgggctcggtggctcacgcctgtaatyccagcactttgggaggccgaggcgggcagatcatgaggtcaggagattgagaccatcccggctaacacggtgaaaccccatctctcctaaaaaaaaaaat

SEQ ID NO: 80460 - DNA, 201 bp, Homo sapiens
gcggaaagccgccgggcattttccggggttccatagatgtccccagtgtcctagtccgtgcatcagctcgcgcactcggagggactctaggcagggggagrgccccgcggccagtatgtgcgtccgaggctttcccgcagggggcagtgccgcccgcccgcgcgccgatacggtgggagggggtgggaacctgcgcggagt

SEQ ID NO: 80461 - DNA, 201 bp, Homo sapiens
cagatccttggaagaaaggtaagacctgccctctccctccaggccagggaggcagcgtccctgcattgatggctccgtgtggtctctgaccctctctcccscagtggcacaacctgtctcgagaagaacaggccaagtactacgagctggcccggaaggagcggcagcttcactcgcagctctacccaacctggtcagccc

SEQ ID NO: 80462 - DNA, 201 bp, Homo sapiens
cccaacttctctgtatgtttggaaaagttcggaattaaaaacccaggataaataaactaaggcctatttcttcagccacattcaaagtccctgtagtctcmcatctggaaaccctgcagtctgcctaggccgtgtcctccacctcaggccaaggttgcagcaggtccttattctcttgtccatgatgaagcttttcgtggg

SEQ ID NO: 80463 - DNA, 201 bp, Homo sapiens
atctggaaaccctgcagtctgcctaggccgtgtcctccacctcaggccaaggttgcagcaggtccttattctcttgtccatgatgaagcttttcgtggggrgtccgggtagcaaaatactctcaccctgtcctcactctgtggaatcttccatacaacccgaattagggattgcttgtgtgtccccctcccacctgtcact

SEQ ID NO: 80464 - DNA, 201 bp, Homo sapiens
ccttattctcttgtccatgatgaagcttttcgtggggggtccgggtagcaaaatactctcaccctgtcctcactctgtggaatcttccatacaacccgaaytagggattgcttgtgtgtccccctcccacctgtcactctttccccacccctccccacgtgatgctgtgggaacccaaaccccagcacctcctagatgagg

SEQ ID NO: 80465 - DNA, 201 bp, Homo sapiens
ggaactatgatctccctactgcactccagcctgagtgacagagcaagaccctgtctccaaaaaaaaaaaaaaaaaaaaaaaattagtcacaaacattttcrtgttgtttgggtatttgtttttccattcaacatttaatccttgagtaggtcctagcagtctgggcagtgtcttagggactaaggtattataaaaagatag

SEQ ID NO: 80466 - DNA, 201 bp, Homo sapiens
ttattctcttgtccatgatgaagcttttcgtggggggtccgggtagcaaaatactctcaccctgtcctcactctgtggaatcttccatacaacccgaattrgggattgcttgtgtgtccccctcccacctgtcactctttccccacccctccccacgtgatgctgtgggaacccaaaccccagcacctcctagatgagggc

SEQ ID NO: 80467 - DNA, 201 bp, Homo sapiens
taatataattaagataattgtcactgtaggcaaatggtaggtacagacaaagtggccctctgttggtttcccagcctggtaaaatgaatgtggatagataygagtggggagggaggagggaggaaagtgcctgggatatatgatccgatctctctgacatcttaggtcttttttattgtttggcctctaaactgcaccact

SEQ ID NO: 80468 - DNA, 201 bp, Homo sapiens
agcaaaatactctcaccctgtcctcactctgtggaatcttccatacaacccgaattagggattgcttgtgtgtccccctcccacctgtcactctttccccrcccctccccacgtgatgctgtgggaacccaaaccccagcacctcctagatgagggcagtggtagggcgctaggtggagatggggagaggaggaaagacag

SEQ ID NO: 80469 - DNA, 201 bp, Homo sapiens
caaaaaaaaaaaaaaaaaaaaatacctcaagaaagaatctaacctaccctcaggtaaaacaaaaaatgtgtttgggatttagtgccatccacaaagttaakcaaaggcataaatgactcattcttaagaaagaagggataagagtgtaaaacttcttttatacttttgcccctggaactctttgtctaatccatcttgttt

SEQ ID NO: 80470 - DNA, 201 bp, Homo sapiens
ttaagttggaccatcataggttagggactgtctgtagtttttacttattaattatgttattgacttaaactatgttctgggtgggatgcatagaggagagktaccatgggagggtaagagtatagtaggagtattagagtgcatgagctgaaaacactttgctttctactttacaacataagctttttttgttataaaatc

SEQ ID NO: 80471 - DNA, 201 bp, Homo sapiens
cctcctgagtagctgagactacaggcgcccgccaccacgcctggctaattatttgtattttagtagagacgggatttcaccgtgttagacaggatggtctygatctcctgacctcgtgatccacccgccttggcctcccaaagtgctggtattacaggcgtgagccaccgcgcccggccatgttcttgactctttaaagat

SEQ ID NO: 80472 - DNA, 201 bp, Homo sapiens
aacctctttcgttcagcacaagcacacgaaaggctttgctttattatttctcagaccatctcatctcaggcttgtgtatgaaattgtcctggtcctcaaaygcgtgctcatttttaagtcctttatatcccactgcttcccatgggcagtcttgctcatatcctgggagctcctgttctttcagacccaaaggaacccaag

SEQ ID NO: 80473 - DNA, 201 bp, Homo sapiens
caagaaagttactacttttcttctttgtaattaatcagtactttatgggacatactttgagactatgtaaatatcccatttctcatcaaacctttacccartggttttagtggccattgatgattcttgccagaaacaatttccactgtgacagttgccaaattgatgatcagtttttaaaaattgacagtgtagggcagg

SEQ ID NO: 80474 - DNA, 201 bp, Homo sapiens
caccccatttgagggctgaggggtgggggtacagaggtcgcaaagtgaaaagactgtcctaattcatagggcttcgttcccacttcccaccaggtctcccrcgccaggcctgcttggcccatcccatgtgctagtctggcctgtggcacgtgtgaccttaagttgttgttcctgcccatggacacctttttgaaagcccag

SEQ ID NO: 80475 - DNA, 201 bp, Homo sapiens
gccaggctggtcttgaactcttgacctcgaatgatttgcccacctcggcctcccaaagtgctgggattacaggcatagccactgcgcccggcctagctccytttaaaatttgggatagtcacccctacttgtcattgcagggttgatgtgcagattacactgggttttgtgtgtgaaaatgctttgacaagtgcaaatgta

SEQ ID NO: 80476 - DNA, 201 bp, Homo sapiens
accacgcccagctaatttttgtatttttagtaagagacggggtttcaccatgttggccaggctggtcttgaactcttgacctcgaatgatttgcccacctyggcctcccaaagtgctgggattacaggcatagccactgcgcccggcctagctccctttaaaatttgggatagtcacccctacttgtcattgcagggttga

SEQ ID NO: 80477 - DNA, 201 bp, Homo sapiens
acatccgagcaaagagaaggctgcgggtggagagttgaggaagacagtcttaggaaaagcttcgtgacttggtcttgtgcaaggtgtgggatttgaagtcmagagacctaggctccagctccagctgtcttgtatgaagttggggaagcgtttagcctttgtttatgtccattagctccttttttttttttttttttgaga

SEQ ID NO: 80478 - DNA, 201 bp, Homo sapiens
gctattgccaggccatcagttgcattgatgccattcatcaccatttcaatgtgttacattccagtgggcatcccccaggagggaggtggctggaccagccygtgtacacatcttcgctatgggctgaagcccagccacgacacactggtcaggagctgggccttgcagagccagttaaatgtagcctagactgggcatgga

SEQ ID NO: 80479 - DNA, 201 bp, Homo sapiens
tgtcctgtcttagatagtcacaacatatgtaaatcgaagacagtagtacctgccgtttgggtttggtgttttcctttctaattttgagcatccaaaagcgrgtatttaacccatagaaagcaccccagaagtgggagcgatcgctattgccaggccatcagttgcattgatgccattcatcaccatttcaatgtgttacat

SEQ ID NO: 80480 - DNA, 201 bp, Homo sapiens
aaagaagagtttgggtaaggaaaggcttatcccaagaatgacaaatcctgtcctacttgcaaagacctcagaaacataccattgctcagaaggacctgaargcacattccaggtcccagagtcttttctctctcctattgccctgcagagactcttgacttaccttcacatttttcgtagcctgcagcacaccactttcag

SEQ ID NO: 80481 - DNA, 201 bp, Homo sapiens
agattggaaaactgtgtatctgtcctgtcttagatagtcacaacatatgtaaatcgaagacagtagtacctgccgtttgggtttggtgttttcctttctawttttgagcatccaaaagcgagtatttaacccatagaaagcaccccagaagtgggagcgatcgctattgccaggccatcagttgcattgatgccattcatc

SEQ ID NO: 80482 - DNA, 201 bp, Homo sapiens
ttcaacagatggggagaagaccatcattctcagtttttgaggcagagcatctcattccaacgagaggtgtgtacgtgcaggagcaaaacctgagacacccrgggaggagggtatatgagtgggaggctgtataatacacttggttgcaatcccagatccacctctttctatttatgcagctccaagcaaattacctcatct

SEQ ID NO: 80483 - DNA, 201 bp, Homo sapiens
taataacagtctagacctaatagggttgtcatggagactgaatgagttggtaggtgaaaagaaccagcacctggcacagtcagtgctcaagaaatgttaaygtgcatgggacgtggtggcttatgcctgtaattgcaacactttgggaggctgaggcaagaggatcactggagcccaaaaggtcaagggtgcagtgagttg

SEQ ID NO: 80484 - DNA, 201 bp, Homo sapiens
taactgtgaaccacagtagcagaaccccagtccccagaaaagtgtttctcagattcagtgagattggaaaactgtgtatctgtcctgtcttagatagtcayaacatatgtaaatcgaagacagtagtacctgccgtttgggtttggtgttttcctttctaattttgagcatccaaaagcgagtatttaacccatagaaagc

SEQ ID NO: 80485 - DNA, 201 bp, Homo sapiens
caaataataactcagcattgtggtggagcaggggtcccttattttgtctaagggcagagaagcatgaaccgttgccacacatggcattatagatagcaacrtggatagttttctagtaaattttatattaccgtagtctatattataatatagcaaagcagacacaggcctcaaaaacttaaggaacatttatgggagaaa

SEQ ID NO: 80486 - DNA, 201 bp, Homo sapiens
gttcacctttacttaggaatgtaaaagtcaaaaatttaaaacatgactagcattccacaacacagcgtaagaaggaacaaaccaccatgaccaaatagggyttacctgggaaatgcaaaaatgccttcatgtaagaaaatctattgctatatatacatctcataaatgagtcaaataagagaaaccacatgaccattttgg

SEQ ID NO: 80487 - DNA, 201 bp, Homo sapiens
cggtgaaacaccgtctctactaaaaatacaaaaaattagccaggcgtggtggcgggcgcctgtagtcccagctactagggaggctgaggcaggagaatggygtgaaccccggaggcggagctgatagtgagccgagatcgcgccactgcactccagcctgggtgacagagcgagactctgtctcaaaaaaaaaaaactgat

SEQ ID NO: 80488 - DNA, 201 bp, Homo sapiens
atcctgggctcaagccatcctcctgcctcggcctcccaaagtgctgggattacaggtgtgagccaccatacctggccctattttctttcttaaaaaccatmaaaagagtcctactctgaatatttttatcagtagcattcttagttttgagcagtaggtatcagctgactgagatcagaaaaaggatttctttaaaggaca

SEQ ID NO: 80489 - DNA, 201 bp, Homo sapiens
tttggaactcttattggatttgggaatatttgcattatactgaccagctgagcatctgtaattggaaaatctgacatgccccagtcagcatctcatttgaktgtcatgttggcactcaagaagtttcagatttttgagcattttggattttgtattttcgattttggggttagggatgctcaacttgtactagcattaaat

SEQ ID NO: 80490 - DNA, 201 bp, Homo sapiens
ctctagcaccatcccagactagggtttacatttctttggaccacccccatatgatctaaggacatccctggtaagccaacaagaatgaatgtgtgtctttrtggccctaaatagggggcagatgctggtagagttgatggatttttaggtacccatctatcctgtttaatattagggggtatagatttgggatacttctct

SEQ ID NO: 80491 - DNA, 201 bp, Homo sapiens
tctggcgtggagatcgttcaaaggtgggaaactacgggaggaaggtactcaggtgttgagtgcagccatggggccacttgaattagcatccaggcagcccrcgcccctccccagagacaatcagcggtgtttcagtgacaggtggggattgatgagttgtgtgacacctgacatgctaacctacaaccacgtgccttccca

SEQ ID NO: 80492 - DNA, 201 bp, Homo sapiens
tatttttaaaaagagaaactacccctcaccaactctttagttacctcagatcagaggtcagcaaactagagtctacaggctgagaccagtttgccacttastttgataaataaagttttattagaacacagctatattcatgcatttgcatattgtttagggcagctttggggcactacaaggtgcccagttaattagctg

SEQ ID NO: 80493 - DNA, 201 bp, Homo sapiens
tacaggctgagaccagtttgccacttactttgataaataaagttttattagaacacagctatattcatgcatttgcatattgtttagggcagctttggggmactacaaggtgcccagttaattagctgtgattgaagccatatgtggcccaccgagctggaaagattttctgtcaggccctttgcagtaaaaatttgctga

SEQ ID NO: 80494 - DNA, 201 bp, Homo sapiens
ctctctttttttttttttttgagacagagtctcactctgtcaccgaggctggagtgcaggggcgcgatcttggctcactgcaaccccagcctcccaagttsaagcaattctcctgcctcagcctcccaagtagctgagattacaggcacgtgccaccatgcccggctaattttcgtagttttagtagagacagggtttcac

SEQ ID NO: 80495 - DNA, 201 bp, Homo sapiens
tcccaaagtgctgggattacaggtgtgagccaccacgtccagcctagtctctttttttaaatgtactcttaatattggtgattctgttcatcaatcccccyacttaatagttgtataattttacatgataattgctttctacataaaattaatatttttcatgcttatattttactctttcaacaaaaaataagcatatat

SEQ ID NO: 80496 - DNA, 201 bp, Homo sapiens
gcaagtgtgggacagggtgaggacggctggggcggggccctccctaccttctgggagccggagggttaatctccgtagctcattggcagtcctgcctctgwacagggcatgctgggatttcctcccagctgttttacatcacgaagatttgtgtgttggggaaattccagggcacagctgcaattaatctgctccatggct

SEQ ID NO: 80497 - DNA, 201 bp, Homo sapiens
ggtcttttttattgtttggcctctaaactgcaccactttaggctttgctgctctaaggcctagaggtagtataaaattaggtgaccccagttatctgctgstctaacacttcctctggaaataccaagccagatgcagaagtgggaattgtctggattgttttcagggtgttaatgaaccctaggaatagcaggcaggagg

SEQ ID NO: 80498 - DNA, 201 bp, Homo sapiens
ttttataggcctgtgccaaggaaaatacttgagaattacattagcaactccaaggtattttggctgctctgagaggacacatgatagttttccagttataygaacaagagcttttgttttatactgaagtttcttataggctatgagaacaatagtgcctctttaagtacttcccagagtaacatccttgggatgttatta

SEQ ID NO: 80499 - DNA, 201 bp, Homo sapiens
tcggggtctgtccgtgtggaggaatgaggaccacagtccactggcccacaggtacatgcatgcccttagtgggccgacttctgggaatacaccagcatccrtagagctaaggatttaccgtatgccttgtcctcagaaaaatcgcttcccctgcccatgtcgccctgattactgtaacagcttcaacgcatgaaccagatt

SEQ ID NO: 80500 - DNA, 201 bp, Homo sapiens
ggagctgtggattctgtaacatgaagctttgtttcctctgttgcccaggccctgcttaaaggcttttctgtgagaacgtgcgaacagggagaatgtgggcrttcccccgagccctgtagagtcctgtccacactaagcaagtgtgggacagggtgaggacggctggggcggggccctccctaccttctgggagccggaggg

SEQ ID NO: 80501 - DNA, 201 bp, Homo sapiens
gggggcagagtggcgtgggtgggtatgggcaggccagagaacaggctgcaggctgtgaaggagaaaggcatttgctctttcagcccagtctgagctcctgrtcagaggccagcaggtggactctgcatcctgtgggggccagggcagatgttctcacctgagggcctgaggggagggaagcgtgtcagtagattcccaggc

SEQ ID NO: 80502 - DNA, 201 bp, Homo sapiens
gaggtcaccatctccagcacacttggtaagtctgtttcaccttaaagcaccaaagggccactattagtggcctcatcccatgccactgccttctgccatcrcgctgaagcagatggggtccaacagtgtttcctcaaatgtgtgagtacagtgaggaagagctgagtgcttggggctaacaattgggttgtgacctcaaca

SEQ ID NO: 80503 - DNA, 201 bp, Homo sapiens
gaatacacatgcctggctgggtgtggtgatgcatgcctgtagtcccagctactctggaggctgaggcaggagggttgcttgagcccaggagtttgaggctkcagtgaagtatgattacgccactgcaccccaccctgagcaacagagggagacccttctctctcaaaaaaaataaataaataattttaaaaaaagaaagtc

SEQ ID NO: 80504 - DNA, 201 bp, Homo sapiens
ctctgcctactgggcctttcctctagaagcagcggaaggcgttctctgggctggagttttctcacctgtgcagtttttggagctgacttgttttccttgcrtgcaactgtggggagctgtggattctgtaacatgaagctttgtttcctctgttgcccaggccctgcttaaaggcttttctgtgagaacgtgcgaacaggg

SEQ ID NO: 80505 - DNA, 201 bp, Homo sapiens
cagcagaggacagggacagaggtgacaccccatttgagggctgaggggtgggggtacagaggtcgcaaagtgaaaagactgtcctaattcatagggcttcrttcccacttcccaccaggtctcccgcgccaggcctgcttggcccatcccatgtgctagtctggcctgtggcacgtgtgaccttaagttgttgttcctgcc

SEQ ID NO: 80506 - DNA, 201 bp, Homo sapiens
ccttgcttctctatcaaaggggatcctggctctaggtccccaaagtcactgtttaccataggggtccagagaggcaggaaggaccggtcaccaaaactggraccctttgtgtctgctgatgggcaagtggccaaaaatgggcgagaccatggggctggagcaaggggcgctttctctgcctactgggcctttcctctagaa

SEQ ID NO: 80507 - DNA, 201 bp, Homo sapiens
gttgcattgatgccattcatcaccatttcaatgtgttacattccagtgggcatcccccaggagggaggtggctggaccagcctgtgtacacatcttcgctrtgggctgaagcccagccacgacacactggtcaggagctgggccttgcagagccagttaaatgtagcctagactgggcatggagaaaccagcagttttaac

SEQ ID NO: 80508 - DNA, 201 bp, Homo sapiens
ctctccttgtcctcttagaagctctatgtaacaggaacctatactataaccgtattataaatgaaaaatgtgaagaagcgatccgtgtctccccgtctccmttctgccacagttgcagtcgtttctttcctggactacggcaaatcctaccagagtcagccttctaaacaccagtcacatctctcccctgctctaaaggct

SEQ ID NO: 80509 - DNA, 201 bp, Homo sapiens
tttaacccatagaaagcaccccagaagtgggagcgatcgctattgccaggccatcagttgcattgatgccattcatcaccatttcaatgtgttacattccrgtgggcatcccccaggagggaggtggctggaccagcctgtgtacacatcttcgctatgggctgaagcccagccacgacacactggtcaggagctgggcct

SEQ ID NO: 80510 - DNA, 201 bp, Homo sapiens
tcggcagactaagccagttactgtgagaagcaggcgttgcccatgagtgaaatgggctcctgtgtggcggcttcccaccacagtgacaatgacattattcmaaatgctctccttgtcctcttagaagctctatgtaacaggaacctatactataaccgtattataaatgaaaaatgtgaagaagcgatccgtgtctccccg

SEQ ID NO: 80511 - DNA, 201 bp, Homo sapiens
aacactcgataaagatgtcacccaaagaaaagaaaactttgttcacctttacttaggaatgtaaaagtcaaaaatttaaaacatgactagcattccacaayacagcgtaagaaggaacaaaccaccatgaccaaatagggcttacctgggaaatgcaaaaatgccttcatgtaagaaaatctattgctatatatacatctc

SEQ ID NO: 80512 - DNA, 201 bp, Homo sapiens
gtgattagatattctgatttcaatttttttttgagatggagtttcgctcttgttgcctagggtggagtacaatggtgtgatcttggctcactgcaacctcygcctcctgggttcaagcgattctcctgcctcagcctccctagtagctgggattacaggtgcccgccaccatgcccagctaattttttgtatttttagtag

SEQ ID NO: 80513 - DNA, 201 bp, Homo sapiens
tggtggctgggcagtgagcatagacactgcacagacactgcccaggcccagcaaacccaaggtcacagccgatgggagaggcagcttgcgactcagcaggmccagcactccaggctgcagaaatgtggactcgaaagcaagttgaactttgacattgtttgaaagcctagggctctgtcccggcgtccccctggtcagggc

SEQ ID NO: 80514 - DNA, 201 bp, Homo sapiens
tgtctgtgagcatgggccccttgagtcggttatggcacctcctgtaacccaggaggaggcagctctgtggggatggctatgggaccagccctactatgccrgcgaatggagtgggggcagagtggcgtgggtgggtatgggcaggccagagaacaggctgcaggctgtgaaggagaaaggcatttgctctttcagcccagt

SEQ ID NO: 80515 - DNA, 201 bp, Homo sapiens
gatcacatacatgatagggtcccataaaattgtaatactatatttttactgtgccttttctatctttacatatgtttggatacacacgtaccaatgtattrcagttacctgcagtattcagtacagtaacatggtgaacaggtttgtaacctaggagaaacaggctataccatatactctaggtgtgtagtaggctatacc

SEQ ID NO: 80516 - DNA, 201 bp, Homo sapiens
actgcaacttctgcctcccagattcaagcagttctcctgcctcagcctcccaagtagctaggattacaggcacccgccaccacacccggctaatttttgtrtttttagtagagacgtggttttgccatattggccatgctggtcttgagctcctgacctcgtgatcctcctgcctcggcctccgaaagtgctgggattaca

SEQ ID NO: 80517 - DNA, 201 bp, Homo sapiens
tccttatttttatttttattttttgggacaaaatttcgctcttgttgcccaggctggagcgcaatggcgcgatctcggctcactgcaacctccgcctcccrggttacaggcatctgctaccacgcctggctaattttttttttttttttttttttgaaacggagtctcgctctgtcgcccaggctggagtgcagtggcacg

SEQ ID NO: 80518 - DNA, 201 bp, Homo sapiens
aagaaaaatatgaaaaaggaactaataaaattgcctgaaatgttaaaaatccagcgataacatttgggtgactatgcttccagattatttaattggctttwctcactgaacagtttgtccagcacactttattcaggtcaataaatgtggatgaccgggcatggtagctcaaagctataatcccaagcactttgggaggct

SEQ ID NO: 80519 - DNA, 201 bp, Homo sapiens
ctgggcacggggcagctggaggagtgccttatttgaggctgctctcgcatcatctcattagggataatcatttgtagacttgctgccactgcaaaccatcrgccccgctcaaattttccctgcagcagtgatgatgaagtgattccttagcagaactgctgggtaacacaattaattcagacttggggtggatgttagtgt

SEQ ID NO: 80520 - DNA, 201 bp, Homo sapiens
tggtgccatctcagctcactgcaacctcctccctccaaattcaagcgattctcctgcctcagcctcccaagtagcggggattacaggcgcctgccaccacrcctggccaattttttgtatttttggtagagacagggtttcaccatgttggccaggctggtctggaactcctgacctcgtgatccacctgccttggtttcc

SEQ ID NO: 80521 - DNA, 201 bp, Homo sapiens
ggagggctctgtacagagctgtcactgcatcttgatcatctggtaggcagtcctgtaagaatgagtagcctcctgctagctttaaacagcacagttttatrttttagaaagatatttctagaggtaagtgaagggtagactggaagagatgaactgagaacaggagcactgatgactcaatggagagaggatttgggatcc

SEQ ID NO: 80522 - DNA, 201 bp, Homo sapiens
aagtagtggaactgatctcaaggcagggaaaggttagtgtcacaacagaagaacagtgagctttggagcctcaaagaaagaggggccatctccctgtcctkaaaagaaatcttcctcctttttactaccatcgtaagagtttacctactccaggccctgtgcatgctaagcgttcactcagttaaaccaccacacaatctt

SEQ ID NO: 80523 - DNA, 201 bp, Homo sapiens
gtgcccggccacaagtatggtttcttacaagaagggggcagaggaaaatttgtcacagacaaaaaaaggagaaggcaatgtgattacagacgcaagggtgrgagtgatgtggtcacaagcccccagaagctgcaagagacaagggtagattcttttcggagcctccagagggagcatggccccgtcaacacctccatttct

SEQ ID NO: 80524 - DNA, 201 bp, Homo sapiens
ccacctcctctatgaagttttcagttgtaacacgataattcttgcccattgccatccctgtcttatctgaacctgtcatttataggcttatagtctagttrtttatgtactttaaaaatctctcctgtggtatatcatgcatataaacagccaccttttatatgagatactcactaaactttgatggagggctctgtacag

SEQ ID NO: 80525 - DNA, 201 bp, Homo sapiens
ctctaggctaggtgcagtggctcacgcctgtaatcccagtattttgggaggcggaagcaggcagatcatttgagtctcaggagtctgagaccagcctgggyaacacagcaaaaccccatcactacaaacgatacaaaaaattagccaggcgtggtggcacgtacctgtaatcctagccacttgggaggctgaggtgggagg

SEQ ID NO: 80526 - DNA, 201 bp, Homo sapiens
ttgacttaaactatgttctgggtgggatgcatagaggagaggtaccatgggagggtaagagtatagtaggagtattagagtgcatgagctgaaaacacttkgctttctactttacaacataagctttttttgttataaaatccttgttagggagagtgagacgctggtgctgaagctttggagtggaaaatgggtcatctt

SEQ ID NO: 80527 - DNA, 201 bp, Homo sapiens
tctaggctcttggcaaggactgtgccatgccagagagagagagagattgtgtgtgtgtgtgtgtgtgtgtgtgtgtgtgtgtgtgtgtgtgtgtgttggggaagtactgtttggtttgggttttttgcactgacatgagaaagaatggggtgctgggtaatctttttcagggttgagagacgctataatgaaggaaagctc

SEQ ID NO: 80528 - DNA, 201 bp, Homo sapiens
gcttgcgactcagcaggaccagcactccaggctgcagaaatgtggactcgaaagcaagttgaactttgacattgtttgaaagcctagggctctgtcccggsgtccccctggtcagggccaccacagaatggctgtgcctagtgctctgggagcagagttttccctcctccagagcatgcagctgtcgggggacatacctag

SEQ ID NO: 80529 - DNA, 201 bp, Homo sapiens
caaactcctgacctcaaatgatccacctgcctcggcctcccaaaatgctgggaccataggcttgagccatcatacccagccagtaacattaacttttcatrtcattatcttactcacaatatagattgaacttttggccgtgtcccaataatgtccgtgatagcccatgtgtttctcctggtcccgggttccacctggcat

SEQ ID NO: 80530 - DNA, 201 bp, Homo sapiens
tcactaactgaaaattggcattttcttcaattatgaatgtagactataaaccacagggacattaacagttctcatgactgtcaccagtagcaattgcaaartgcatttttaaaaaatgtttgtgggtacatagtacaccgatgtatttataggtacatgaaagcaaagttaattttttacagtgtggtagagtcattgtaa

SEQ ID NO: 80531 - DNA, 201 bp, Homo sapiens
agagtctgtccatccctctacaattagatgagattcctggggcatcaaggtcaagcagatccagctttgaattgctgttctgccactttaacaccgggacsttctgaaaaacagttgccctctctcaggttccgtttctttgtgaattgggtgaactcttgagtgttctttagcaaaggagtacctgtaacgtgctccacc

SEQ ID NO: 80532 - DNA, 201 bp, Homo sapiens
tatccttagcaattcttaatacttcagaattaaggttgttatgagattcgctgctaggtcttatttaatatgttaattaaatattaccatggtggaaaatwtaaaatattttgataactgcattttactgtaattggtttcctttgcaatgctgtgtatttaatttgtgcatttagcatcattctgtggaggcctctgtgg

SEQ ID NO: 80533 - DNA, 201 bp, Homo sapiens
gctctgacctttgagtctgtgtgcagaacctctttctccaattcctaggggtgccctcatccacaactggcagtagcccctggatggccacaaacatgcartcctacaaccatattccctggatgtcacttcctcacataatctttgccacataccacctatactatttacataattatttttctttgaattgattcactt

SEQ ID NO: 80534 - DNA, 201 bp, Homo sapiens
tttactgtaattggtttcctttgcaatgctgtgtatttaatttgtgcatttagcatcattctgtggaggcctctgtgggcttccctagcctaccaaggagkggtctgtggcattgaagaggatagggatccttggtttgcatttatagtaactgtttcctgttcccagtcagtgaataaatcctgtaagtggagataactc

SEQ ID NO: 80535 - DNA, 201 bp, Homo sapiens
gaaggaaatcctgccgtttgtgacaacaaatggatggacctggaggacatcatgctaagtgaaataagctagtcacaggacaaatattgtatgattctgcytgtatgtgggatcgaaaatagtcaaacttaaagaacgctggttgccagggaatgggggaagagggaaatgtgttgttcggtgggtgtaaagttacagata

SEQ ID NO: 80536 - DNA, 201 bp, Homo sapiens
tgtatgtgggatcgaaaatagtcaaacttaaagaacgctggttgccagggaatgggggaagagggaaatgtgttgttcggtgggtgtaaagttacagatawgagatgagtaagctctgcagctccgctgtacaacatagtgcccatggtttagagttgggcacttacaactttattaagagggtcaatctcatgttaagtg

SEQ ID NO: 80537 - DNA, 201 bp, Homo sapiens
gtgttgggattacaggcgtgagccgctgcacccagcctccatattctttattctagctgctcaagcagttttctccacacctgtgcttctttaaaacagtkgacttgatggaaaaattgaatgttaccactttagttggatcctggagatggataattcattgataaggactgccatccacttggatgctttcttcagagc

SEQ ID NO: 80538 - DNA, 201 bp, Homo sapiens
atcgggcgcagtggctcatgcctgtaatccaggcaccttgggaggctgagacaggcagatcacttgaggtcaggagttcgagaccagcttgaccaacatgrtgaaaccccatctctactaaaaatacaaaaaatttagccgggcatggtggcacgcacctgttaatcccacccactggggaggatgaggcaggagaatcac

SEQ ID NO: 80539 - DNA, 201 bp, Homo sapiens
ttcagttttcactcctgcccaactggtttcttcgcagtctatgcccagggcctccagctttctcacacttgggccctgctggggcatccagcctctgctcytacatccttgggtcactgcaggtccctgcccgaccctacctttcttcctccggacctcatattagaccagctcctcaggcctttttggacatgaccgtct

SEQ ID NO: 80540 - DNA, 201 bp, Homo sapiens
atccaccacactatataaaagagagacctggagtggtggctcatgcctgtattcccagcactttgggaggtcgaggaagaaggatcacttgagcccaggcrtttgaaagtggcctgggcaagaaaacaagaccccatctctacaaaataataaaaaactagccaggtgtggtggcgcatgcctgtagtcccagctactcgg

SEQ ID NO: 80541 - DNA, 201 bp, Homo sapiens
atcagttggaagtttctttattttttatttagagacagagtctcactctgtcacccaggctggagtgcagtggcgcaatcacagctcactgcagcctcgarctcgagggctgagtcgatcctcccagctcagcctctcgggtagctgggactacaagcgtgcgccaccacacctggctaattttttttgtatttttgtaga

SEQ ID NO: 80542 - DNA, 201 bp, Homo sapiens
tgctatctcggctcactgcaacctccacctcccgggttcaagcgattctcgtgcctcagcctcctgagtagctgggattacaggcgccggccaccacgccyggctgatttttgtatttttagtagagacagggtttcgccatgttggccaggctggtctcgaactcctggcctcaaatgatcacccacctcagcctcccaa

SEQ ID NO: 80543 - DNA, 201 bp, Homo sapiens
cctcagactgaaaccctccgttacctgctgctatgcagggattaggattagaacagggctgagtgggctggtacggggagggccctgctgtggtgttggtwtagctccttttagcacaaggaatttgatgagctaagcattttccacggcaagtgcataaaaaagatttcttaccattttttgaaagaaagaaatatatcc

SEQ ID NO: 80544 - DNA, 201 bp, Homo sapiens
aaatcaatgacccatttgaaccatgacttggagtttaattcagcgtgtatctgagtgactacgtgagtactcctgacctccaggaatggatagaatggaayatggaaaatcaaggtggatcaaatgagaatttggccagtggacttacaaaaaagtattcaaatgggccacacctacccagtctggtgctgtgcatgcatc

SEQ ID NO: 80545 - DNA, 201 bp, Homo sapiens
cataaatacttgttgactgacttgactcattcccttggggagggaaaaaaaaaacaggaggaagtagggaaagggggagtgaacttggttttccgtctctygtaagtatcataaggaaatacctagcctaatgtctgttggcagactatgactgtttgcattctacaaagtagcatttgaaattttagtttttgcttttca

SEQ ID NO: 80546 - DNA, 201 bp, Homo sapiens
aactgcccccctgcaatatgaaaggcacatgttccccaaatgtgactttgggggctctctggggtttaataacaaacacttgcttggtttttgggactggygtttcttcaactcacccatgcatgggaaccgtctgaagagattgtgtaaacgcagattctacttcagtagggctgtcgtggggcctggaactctgcattt

SEQ ID NO: 80547 - DNA, 201 bp, Homo sapiens
actgtccacagtgctgactcaatgcaatggtgttatttattgcttctgctagtggtggtggttggcttggttctgatctccagatgtaacagtgccatccmggcaagtgaaatcatgcattgggaaaaaatcgaggatggacatctcaacacagttgggtgtagtttccacttgcaattactcataagcttcacaggctta

SEQ ID NO: 80548 - DNA, 201 bp, Homo sapiens
tgggcactacagcttttgcacactggagagaagagcaagaactggcaaaggagactgagaaggagcagccagagaggtaggaggagacctggtgggcgccrcattcctgcagccaaggaggggagtgtacgaaggaagaggggctgctgctgaaggtcgagtgagatgagggctgagaaacaaccattaggtttagcaaat

SEQ ID NO: 80549 - DNA, 201 bp, Homo sapiens
ttcactttctttgtagtattctttgaagcacaaaagtttttaattttgatgaagtctaatttagctatattttctgttatcatttgtgctttaggtgtcayatctaagcaaccactgcctagtcctaggtcataaaaaatatgtctttaatttattctaagatatttataatttcagttcttagaggtctttgatcaattc

SEQ ID NO: 80550 - DNA, 201 bp, Homo sapiens
ggtacttcaagccatgagactggaggagatccctgagactgaagctgagaaaaaaagaggtcaagggctgagccgtgggcactacagcttttgcacactgragagaagagcaagaactggcaaaggagactgagaaggagcagccagagaggtaggaggagacctggtgggcgccgcattcctgcagccaaggaggggagt

SEQ ID NO: 80551 - DNA, 201 bp, Homo sapiens
cgtgccaggcaccttagaaagggccgggtattcatattgtgacttcacacggctccctgcagagttgacgttgggagctgccctgctagccacggaccacrttgtgaacagcaccccctgggggtgggagatgtggtgggcggagttcaggatccagccacagggaaagaacgaacaggcaaactgtgggatcccggcctg

SEQ ID NO: 80552 - DNA, 201 bp, Homo sapiens
gcagtcagcagatgggcagtgaggcggggaagaaaggcggaaccaggcctggtatcagagctggggctggcaggggagaggcagtgttcgggaaagtggartccgcctgaagattgtgggaccttccgtggggaaggtaacccggaagcagtttcagattgggtattggaggagaatgagcggacaaggagcaaatttaag

SEQ ID NO: 80553 - DNA, 201 bp, Homo sapiens
caggattctggctcagggtgagaggtgaaacttcgttcaggagatatacgctgagccatccactacgtgccaggcaccttagaaagggccgggtattcatrttgtgacttcacacggctccctgcagagttgacgttgggagctgccctgctagccacggaccacattgtgaacagcaccccctgggggtgggagatgtgg

SEQ ID NO: 80554 - DNA, 201 bp, Homo sapiens
ataacatgttatggctactcctcggcgccattacatgcctgaggtcccttgctgtccctttgtgtttttgatgaaaggtaacagcctggtgttcccagccrtcacccagaggtgggagcagatccggctgctgcagcttattgctaggaatgggtgaggctgagtggaagctttagtaactcaggtgcggctcttaagctt

SEQ ID NO: 80555 - DNA, 201 bp, Homo sapiens
tgtgcacccaagtctccagaaggagctggagaaggagcagggtggcaggggtgggaaggggacagctgtgtggaaggcagcggggctggaatcctggcatmtaggccctttcacgctcccactcagagggctctctcttcaggccagaaatgctgatatttaatgagcacttactagatggttatttgtccattttataga

SEQ ID NO: 80556 - DNA, 201 bp, Homo sapiens
gttttaaaaactattgaatgaaagggcatgttttcctttcctttccccatttagattacacacctctggcagtggggcctccagcaagtcttaaagatctygacgcaccgacatcttggcacatagtagttaacaataagtaactgttcaattggcttctagttgaacctcatatgtcttggttaacatgtgcaggattgg

SEQ ID NO: 80557 - DNA, 201 bp, Homo sapiens
cattactgggtatatatccaaaaaaattgtgaaatcactgtcaaagagacgatctgtacccccacattcactgcagcactattcacaatagccaagttacrgaaacaacctgagtatccgtcgacagatggatggctaaaggaaatgtgggctctgcacgcaatggaatatcattcagctttttaaaagaaggagccaggc

SEQ ID NO: 80558 - DNA, 201 bp, Homo sapiens; identical to SEQ ID NO: 29747

SEQ ID NO: 80559 - DNA, 201 bp, Homo sapiens; identical to SEQ ID NO: 29749

SEQ ID NO: 80560 - DNA, 201 bp, Homo sapiens
cctgggcaacgtacgttgcaagacccccatctctaaaaataaaaaataaaaataaataaacagaagcactttatttccactctagttgggctaggcctgaygctaggaattcagaactacctggccatcttcaaatgtctagtactgcagtggaagaggattacaagggttgtcactggctcctgctgccccaattcacgg

SEQ ID NO: 80561 - DNA, 201 bp, Homo sapiens
actacagccttcaaaacagcccctgggaaaggccctgctttggagggtagaaggacatataggaggctcccagaggtacgggtgtgcctccctgctgggcrtgggcccgcctgctgggggcagcagcaaaaggaagcaagtagcccggaggaaaaaaagaactatgtgtgtgactgtgtggtggccaggagagagggagag

SEQ ID NO: 80562 - DNA, 201 bp, Homo sapiens
ttctggaggccgaggagggtggatcacctgaggtcaggagttcgagaccagcctgaccaacatggtgaaacctcgtctctactaaaaatacaaaattaagygggcgtggtggcgcacgcctgtaatcccagctacttgggaggctgaggcaggagaatcgcttgaaaccagaaggtggaggttgcagtgagccgagattgg

SEQ ID NO: 80563 - DNA, 201 bp, Homo sapiens
ccacactgcttgcatttaaattttcactcctgttgtttccatgatgagcattcctcaggttctatgccataaatttataatttgggaaatatggtcaccaytaccatatggctcccattgtgtcttctaatttagcaaagatgataaatttgtttcctgaaaattttagggttaaaagcattcaattggatttgattcgtt

SEQ ID NO: 80564 - DNA, 201 bp, Homo sapiens
tgggagaggcagcttgcgactcagcaggaccagcactccaggctgcagaaatgtggactcgaaagcaagttgaactttgacattgtttgaaagcctagggytctgtcccggcgtccccctggtcagggccaccacagaatggctgtgcctagtgctctgggagcagagttttccctcctccagagcatgcagctgtcgggg

SEQ ID NO: 80565 - DNA, 201 bp, Homo sapiens
ataaaacgtgtatgtaaaagaagtcataaacggaggaaggaaaatactaggtaggtaataaagacatttttcatacttttatcctgtttggaatataaatyctttgttctcagctagatttgtactgtactaatgaggaaaggtaaacaacaacgaactgccaccctttgacatgtatatacactccttttctttgcatgt

SEQ ID NO: 80566 - DNA, 201 bp, Homo sapiens
tactaggtaggtaataaagacatttttcatacttttatcctgtttggaatataaattctttgttctcagctagatttgtactgtactaatgaggaaaggtmaacaacaacgaactgccaccctttgacatgtatatacactccttttctttgcatgtgagttggtggataccatgtataaatgtctgcacatgttggctga

SEQ ID NO: 80567 - DNA, 201 bp, Homo sapiens
tgacatgtatatacactccttttctttgcatgtgagttggtggataccatgtataaatgtctgcacatgttggctgagtgtagtttggtgaacatactccrtcccctgcccccagccctgactaagatgcagcaccagatacacattttggaagaactgaccttattgttgtcaagtaggtggaacttgtcagaacgtcat

SEQ ID NO: 80568 - DNA, 201 bp, Homo sapiens
cagtctagtcatctgcaaaatggagctagcagtgaaaacagtatgtattaaatgagatgatacatgtgaaacatgtagagctctaattttatttttttttwatttatttttttgagacagagtcccgatctgttgcccaggcagtggtgtgatgttggctcactgcaacctccgcctcccggattcaagcgattctcatgc

SEQ ID NO: 80569 - DNA, 201 bp, Homo sapiens
tagtagagatggggttttcagcatgttgttcaggctggtctcgaactcctggcctcaggtgatccatctgcctcggcctcccagagtgctgggattacacktgtgagccgtggcacctggcctaactaatctttttttttttttttttaagtgcactgcactgaagtgcagtggtgtgatcacagctcattgcaaccttga

SEQ ID NO: 80570 - DNA, 201 bp, Homo sapiens
gtaagtgaggcattcccactgcccaaccccttcccctgactgcagtgactgttgctgcttgcctggatggggaggaggagcaagcctcttcctcagccccyggcactccccagccacaccaacctgccgcaggccatccaaactccacggtttcagggccttgcgtgcaggtttctctgcctaggttggtgttacctcact

SEQ ID NO: 80571 - DNA, 201 bp, Homo sapiens
aactccgtctcaaaaaaaaaaaaaaaaaagtaaaaaaaaaaagtcttagctgagaccattcaaaaacaggcagcaagctgtagtatgctgctctagatggytgtttttggtttggcctctatgcctggtgctacaaatcaccaaattctctgaggggatgaaacagcagtgaatacaaactcgcttgaatgaatttccctt

SEQ ID NO: 80572 - DNA, 201 bp, Homo sapiens
ttcctagtacactgtactgttttaaaaactattgaatgaaagggcatgttttcctttcctttccccatttagattacacacctctggcagtggggcctccrgcaagtcttaaagatctcgacgcaccgacatcttggcacatagtagttaacaataagtaactgttcaattggcttctagttgaacctcatatgtcttggt

SEQ ID NO: 80573 - DNA, 201 bp, Homo sapiens
agatctccagttttctgtctccttcaagaaatctccccagggcctctatatccccttttctctgcctccctattgaagcagatgttttacctcagcctttyctagtacactgtactgttttaaaaactattgaatgaaagggcatgttttcctttcctttccccatttagattacacacctctggcagtggggcctccagc

SEQ ID NO: 80574 - DNA, 201 bp, Homo sapiens
cttggttgacagtgatgccttcaactcagctgggttttgttgttttattttggtattttatccagtttatagttagttgttcttgatgaaggagtcaatcygacatcaataccccattagaatgggaagtggaagtctacatgttaattttaatttgctacttttgcttaccattatgagcctccttctatattgacaaat

SEQ ID NO: 80575 - DNA, 201 bp, Homo sapiens; identical to SEQ ID NO: 29767

SEQ ID NO: 80576 - DNA, 201 bp, Homo sapiens
gaggcgggcttaggagcttcagctggggcagggaaggccgttctccaggtactgggggaagggcacaagcaaacagagacacggagccttcagctgccttmtctgcaaggaagatgactactcttttggggggattcagagcagcatcttatccggcacatggcacccgtggtaggaactgagtcatcccgcacagccggg

SEQ ID NO: 80577 - DNA, 201 bp, Homo sapiens
attctggacacagtgggacttgtgctccacagaacccactttgagaaccatagattggtctatggaactgctctagtcttcgtacttcattttcaagtacwaatcactagaatactatagatcttcataattctagttaatttacttcatgttttcagctaacagggaactgttaactaatttaaagatgaggctcagcac

SEQ ID NO: 80578 - DNA, 201 bp, Homo sapiens
agccaggcctgttgaggtgggtctgttagagagccccaggctgtagggttgcccacctgactcagctgcccaagcatctctcctctgtctggcgcttcctyctagcatcctggtttgtattcctactttgagttgaaactgggcttttcactcctgagtagctctagaagacctaagaaccacttcacatctgagaatgat

SEQ ID NO: 80579 - DNA, 201 bp, Homo sapiens
cttcaaggctgcatacacgttgccagaggaaaagcctgaggggatgggtggatatcgccttttaatttgctgttagttttccataaaggaacaaatgcctraaactttccaaaacttagtctaagtttggacagatccctgtgtcttgaaatcttggtcccctcaggaataatgctctatttagagaggaagaacatataa

SEQ ID NO: 80580 - DNA, 201 bp, Homo sapiens
actcctgacctcaagtgatctgcctgcctcagcctcccaaagtgctgggattacaggcgtgagccaccgcgcccggctctgtaacttttttctgagccatytgcaagtaagttgcaggcgtaatgtccctttacttaagggggcataatttgttagattgcatctctgatactatagagcatatttgtgactctaaataag

SEQ ID NO: 80581 - DNA, 201 bp, Homo sapiens
atgggagaggcagcttgcgactcagcaggaccagcactccaggctgcagaaatgtggactcgaaagcaagttgaactttgacattgtttgaaagcctaggrctctgtcccggcgtccccctggtcagggccaccacagaatggctgtgcctagtgctctgggagcagagttttccctcctccagagcatgcagctgtcggg

SEQ ID NO: 80582 - DNA, 201 bp, Homo sapiens
agtagagatggggtttcaccatgttggccagggtggtctcgaactcctgacctcaggttatccactcgtctcagcctctcaaagtgctgggattataggcrtgagccaccacgcccaaccttagaaacatcttaaagctacatcatatcaccagatttccttgcagggggctgaatcagcttataccgggggcaaccatag

SEQ ID NO: 80583 - DNA, 201 bp, Homo sapiens
cctatccctattttaccattaaggaagctgacacacagataaattacttgcctaagtcagtggcaagtcccttaagtcactggcaaagccaggatttgaayctgggctagcctggaacctggcttctttgctgctgtgccacactgtgcttctctatgtcagtgcaacttccaagttttggtggaaatctaccaccataaa

SEQ ID NO: 80584 - DNA, 201 bp, Homo sapiens
aacttctgtggctaccaaggagagcatgatagggtcccagccctccagagcttacaatgtaagagaacaaacaggaacatgagtctttacaatacctgcartgagcgccaacaaagtggaataaaatgtcacctgaaatacctgagaaaggggcttctcaagcttggagaaggcagaggctttggagagatgtttgatctg

SEQ ID NO: 80585 - DNA, 201 bp, Homo sapiens
ccgtgtcaagtggctgtcagcagggtccttttatgactgatgagttttcttttgtttctgtgtgagttgcaaatgggtttgggtcttggtgcacgtcagtrtcttggacccctgaggaaggatgtcatcacccccaggttgagcatgcacagccttcttcaggacggtgagacgaacccgctgagcaggctgtgggcaagg

SEQ ID NO: 80586 - DNA, 201 bp, Homo sapiens
ccctcgtaaggctctgggctttctctaggcggtgtggtcccagatggcagcagagagaagggcagaatctttggaacctgggcagcctgggtgcttttttwtttttttgagattagatctcactctgtcactcaggctggagtggagttgcacaatcttggctcactgcaacctccgcctcccaggctcaagcgatcctcc

SEQ ID NO: 80587 - DNA, 201 bp, Homo sapiens
tagatgcccacccagtgggagtagcacgcagtgagctttatttaggtgctgctttgaatggcaggcttgcatacaagggaagtccctcatagcataagccytttggaggctgaggttccaggagtcaccatcaagagggagaggccggcaagggaactccccgggcagagggggatcagagagggggcttacatgtctagg

SEQ ID NO: 80588 - DNA, 201 bp, Homo sapiens
tggcagcagagagaagggcagaatctttggaacctgggcagcctgggtgcttttttatttttttgagattagatctcactctgtcactcaggctggagtgsagttgcacaatcttggctcactgcaacctccgcctcccaggctcaagcgatcctcccacctcagcctcccgagtagccggaaccacaggcatgtgccatc

SEQ ID NO: 80589 - DNA, 201 bp, Homo sapiens
agtttcacgagtctgcaaagcagacaggctctcagtggctaaaattttgcttacttggtctgtgtgtaaaacaaacggatgtgtaaaactttgagtttggygctagcggtcttttaaaagagctagaccaggtgcggaggcactttgggaggccaaggtaggaggatcgcttgaggccaggagttcgagaccagcctgggc

SEQ ID NO: 80590 - DNA, 201 bp, Homo sapiens
agcagagagaagggcagaatctttggaacctgggcagcctgggtgcttttttatttttttgagattagatctcactctgtcactcaggctggagtggagtwgcacaatcttggctcactgcaacctccgcctcccaggctcaagcgatcctcccacctcagcctcccgagtagccggaaccacaggcatgtgccatcatgc

SEQ ID NO: 80591 - DNA, 201 bp, Homo sapiens
ttcttcatctgcaaaatggggctgaacgatgctgccttacttctgagaggattcatgcaaaatatttacttctgcgctctgctggaggggcggggccagckcgcccagtgggggcggggccctgtggtcgggctccccgggaggggcggggccaggccgtgtcagctgaccggcctggccaatggcacctggcggcggggc

SEQ ID NO: 80592 - DNA, 201 bp, Homo sapiens
ctttggaacctgggcagcctgggtgcttttttatttttttgagattagatctcactctgtcactcaggctggagtggagttgcacaatcttggctcactgmaacctccgcctcccaggctcaagcgatcctcccacctcagcctcccgagtagccggaaccacaggcatgtgccatcatgcccggctaatttttatacttt

SEQ ID NO: 80593 - DNA, 201 bp, Homo sapiens
gccttgtatttttttattttgttttgttgttttaatttgcttttgttttagccattttgttttttcttttttttttttttgagacagagtctcgctctttygcccaggctggagtgcagtggcgcgatctctgctcactgcaagctccgcctcccgggttcacgccattctcctgcctcagcctcccaagtagctgggatt

SEQ ID NO: 80594 - DNA, 201 bp, Homo sapiens
gcagaagaacagttattaggcaatgactgtgtacctggcccagaacactttatctttatttatttatttattttttgagacagggacagtctttgtctccygggctggagtacagtggcgcagtcttggctcactgcaacctccgcctaccgggttcaagcaatattcctgcctcagcttcccgagtagctgggattacag

SEQ ID NO: 80595 - DNA, 201 bp, Homo sapiens
ggggtttcaccgtgttagccaggatggtctcgatctcctgacctcgtgatccacctgcctcggcctcccaaagtgctgggattacaggcgtgagccaccgygcccggcctgttttagccattttaaggcaatttccgaggcaggcggatcacttgaggtcaggagttcaagaccagcctgactaacatggtgaagccctgt

SEQ ID NO: 80596 - DNA, 201 bp, Homo sapiens
gttgcagtgagccgagattgctccactgcacttcagcctggccaacagagctggacttttgtctcaaaaacaaaaaacaaaaaaacacaaatatatatatwtatatacttgtgtgtgtgcgtgtgtgtgtgtgtgtgtgtgttaaccacagaaaaactgcattcattcattcagtcagtccagtcagtcactcaataagca

SEQ ID NO: 80597 - DNA, 201 bp, Homo sapiens
tagagatggggtttcaccatgttgtccaggctggtctcaaatgcctgaccttaagtgatctgctggcctcggcctcccaaagggctgggattaccggcgtragccaccgcccctcgaccatccagctttttttttttttttttcagtttttggtagaaatgtggtctcatgcctgtatcccagcactttgggaaggccgag

SEQ ID NO: 80598 - DNA, 201 bp, Homo sapiens
acagtgggatatgaggaccccacatccctcttcaaagacccttggccatcaccacttgccaggggtgtgccaggtgtagagaatcgggggcaccgagcccmctcagtgactgctgtttgatgggcagggagtgtgggctctggccggggaaactgtggcccaggttgcaaggaggaggctaagaggtgctgcatgctcggc

SEQ ID NO: 80599 - DNA, 201 bp, Homo sapiens
ttgtagagacggggtttcactctgttgcccaggctagtttcaaactcctgaactcaagtgatccatccgccttggcctcccaaagtgccagaattacaggygtgagccaccgcacccggcctactctggctaatttttttaaaaagttttgtagagatgtagtcttgctatgttgcccaatctggcttaaacttctgggct

SEQ ID NO: 80600 - DNA, 201 bp, Homo sapiens
ccccgaggcggagccagcccggcccccagcggcccagcccccgcgtctagtctgccgcaccagccaggcgtctgtccctgcgtccgtgtgtccgtccgtcrgtccgctcgcgccacgatcagggcttccgggggccaacaagggggcgtcggtaccccgccgcacagaggcggcctctgcctcggcatgaagtcccgcagg

SEQ ID NO: 80601 - DNA, 201 bp, Homo sapiens
ccacatcccacgcatggacaggtaatttcaaccagcccagggggtggggggtcatggggggatatagccctaagaatcattaactcactaaagaaatcatkcattcattcacttaacaagagctgattgagcacctgtcatgtgccagacgcttgcatttcatttatttattcatacaacaacattcattaagcacccact

SEQ ID NO: 80602 - DNA, 201 bp, Homo sapiens
gtgaaactccgtctctactaaaaatacaaaaaaattagctgggcgtggtggtgcaacacctgtaatcccagcttctcgggaggctgagacaggagaatcgyttgaacccaggaggcggaggctgcagtaagctgagactgcgccattgcattccagcctgggcaacgagagcgaaactctgtctcaaaaaaaaaaaatttg

SEQ ID NO: 80603 - DNA, 201 bp, Homo sapiens
acctgggcagcctgggtgcttttttatttttttgagattagatctcactctgtcactcaggctggagtggagttgcacaatcttggctcactgcaacctcygcctcccaggctcaagcgatcctcccacctcagcctcccgagtagccggaaccacaggcatgtgccatcatgcccggctaatttttatacttttggtaga

SEQ ID NO: 80604 - DNA, 201 bp, Homo sapiens
cgtcctctatgagtttctggtgggctgcgtgcctttctttggagatacccccgaggaactcttcggtcaggtggtcagcggtgcgtttcctccatgggccygggtttgagctgcagccccaccagagctctgggcagcggtcctccacccgcatgtcagggagagaagcaggaagaggggagggagttggatgccaggtgg

SEQ ID NO: 80605 - DNA, 201 bp, Homo sapiens
atggtggtacatgcctgtaatcccagctatttgggaggctgaggcacgagaattgcttgaacccaggaggtggaggttgcagtgagctgagatggcactaytgcactccagcttgcgcaacaagagcaaaactgcctgaaaaaaaaaaaaagatgcgcaattttacctaattctgtgtgacccatttcaaggaatcactga

SEQ ID NO: 80606 - DNA, 201 bp, Homo sapiens
gtctccaactcctgaactcaagtgatcctcccacctcagcctcccaaagtgctaggaattgtattggttttttgttttgttttgtttgagatggagtctcrctctgttgcccaggctggagtgcaatggcgcagtctcggctcaccgcaacctctgccttccaggttcaagcgattctcctgcctcagcctgccgagtagc

SEQ ID NO: 80607 - DNA, 201 bp, Homo sapiens
aagtgacatgtgagcagagacctgcaagaacctgagaatgagagaaagccatagagacagaaaagagaaaggtggctctgagcatagggcacagctgtggsaaaggctgtcagtgggtaccaagcctgccacgttgcaggggcagaggaggccagtggcttggagtacagtgaagtgaggggaaatggtggatggtactag

SEQ ID NO: 80608 - DNA, 201 bp, Homo sapiens
agcgctgggattacagacatgagccatcgcacccggccttgtatttttttattttgttttgttgttttaatttgcttttgttttagccattttgttttttyttttttttttttttgagacagagtctcgctctttcgcccaggctggagtgcagtggcgcgatctctgctcactgcaagctccgcctcccgggttcacgcc

SEQ ID NO: 80609 - DNA, 201 bp, Homo sapiens
agtgaccccctccctaaccccctgcagatgatggcagcggcggccccctcatgagccccctttccccgcgctctctgtcctcgaacccgtcgtcccgtgaytcttcgccgagccgagacccgtcccccgtgtgtggcagcctgcggccccccatcgttatccacagctctggcaagaagtacggcttcagcctgcgggcga

SEQ ID NO: 80610 - DNA, 201 bp, Homo sapiens
tgatgcacatttgggtctattccaccttgtgaatacaggtaccattttagtttatttacttatttatttatttattgagatggagtcttgctctgttgccsaggctggagtgcaatagtgcaatctcagctcactgcaacctccaccttctgggttcaagcgattctcctgcctcagcctcccgagtagctgggattacag

SEQ ID NO: 80611 - DNA, 201 bp, Homo sapiens
ggccgcatggcacgcaggagcaagaggagccgtcggcgggagacccaggatcggtgcgcggcagtgaccaccagggagcggtacacagggggcggggccayggggactggggttctttttttcttttctttttcctttttttttttttttttttgagacagagtcttgctctgttgcccaggctggagtgcagtggctcaa

SEQ ID NO: 80612 - DNA, 201 bp, Homo sapiens
gtctattccaccttgtgaatacaggtaccattttagtttatttacttatttatttatttattgagatggagtcttgctctgttgcccaggctggagtgcartagtgcaatctcagctcactgcaacctccaccttctgggttcaagcgattctcctgcctcagcctcccgagtagctgggattacaggtgcgcgccaccac

SEQ ID NO: 80613 - DNA, 201 bp, Homo sapiens
cgtctctactaaaaatacaaaaaaattagctgggcgtggtggtgcaacacctgtaatcccagcttctcgggaggctgagacaggagaatcgtttgaacccrggaggcggaggctgcagtaagctgagactgcgccattgcattccagcctgggcaacgagagcgaaactctgtctcaaaaaaaaaaaatttgtctctttag

SEQ ID NO: 80614 - DNA, 201 bp, Homo sapiens
gtctaaactcccaaggcctccattgggcactgagcacattcggttatttccagaaacgctccgcggtcttggggatcagcctcagttgtgccagtgcggcsgtagagagtgttcggccatttccgaaagcgctcgggcgtctctaagcccagccgagcccagtctcggatccctcgccgacccgattgcactcggctacct

SEQ ID NO: 80615 - DNA, 201 bp, Homo sapiens
ggagtgcaatagtgcaatctcagctcactgcaacctccaccttctgggttcaagcgattctcctgcctcagcctcccgagtagctgggattacaggtgcgygccaccacacccggctaatttttgtatttttagtagcgaccaggtttcaccatgttgcccaggctggtctcaaactcctgtcctcaagcgatccgcctgc

SEQ ID NO: 80616 - DNA, 201 bp, Homo sapiens
tttttttttgaaacagagtctcgctctgtctcctaggctggagtgcagtggcacaatctcggctcactgcaacctccgccttctgggttcaagccattctyctgcctcagccttccaagtagctgggactacaggcatgtgccaccacacccagctaatttttgtatttttagtagagacgggttttcaccatgttgacca

SEQ ID NO: 80617 - DNA, 201 bp, Homo sapiens
gtgagctgagatcgcgccactgcgctccaacctgggcgacagagcgagaccctgtctcaaaaaaacaaaaaaagaaagggcagatgaagccaggattcaarcccaggcccatccgattccagaaccaccgcactgttctttgtctctctgtggccttgctcttaggtcacctgtgggaattatgctgagaccctctgatct

SEQ ID NO: 80618 - DNA, 201 bp, Homo sapiens
cccggctcgcccacccacagcctctcccccagccccaccactccctgccgaagcccagcccctgatgtcccagcaggtgggtgcaccccgaccccccaccrccccggctaccctgggagcaagggctggtgggccccaggagggaggaaggagctcaggggatggaatgacacgatgtagggaaaaagatgaccgggatcc

SEQ ID NO: 80619 - DNA, 201 bp, Homo sapiens
cccagcccctgatgtcccagcaggtgggtgcaccccgaccccccaccgccccggctaccctgggagcaagggctggtgggccccaggagggaggaaggagytcaggggatggaatgacacgatgtagggaaaaagatgaccgggatcctggtgtctagcagggaacctgggagtacttagagacgaatgcaggtgccaggg

SEQ ID NO: 80620 - DNA, 201 bp, Homo sapiens
tctcctgcctcagcctcctgagtagctgggattacagacatgcaccaccacacccagctaatttttgtatttgtagtagagatggggtttcaccatgttgkccaggctggtctcaaatgcctgaccttaagtgatctgctggcctcggcctcccaaagggctgggattaccggcgtaagccaccgcccctcgaccatccag

SEQ ID NO: 80621 - DNA, 201 bp, Homo sapiens
cttttgtctcaaaaacaaaaaacaaaaaaacacaaatatatatatatatatacttgtgtgtgtgcgtgtgtgtgtgtgtgtgtgtgttaaccacagaaaawctgcattcattcattcagtcagtccagtcagtcactcaataagcactccttcttgcccactgaggggttgttcaggaggcagttcagtgtaggaattctc

SEQ ID NO: 80622 - DNA, 201 bp, Homo sapiens
gcctcccaggttcaagtgattctcctgcctcagccccccgagtagcggggattacaggcgtgccccattacgcccccttaatttttgtagttttagtagaracgcggtttcaccatgttgcccaggctggtctcaaactcctgacctcagatgatccacccacctcagcctcccaaagtgctgggattacagacatgagcc

SEQ ID NO: 80623 - DNA, 201 bp, Homo sapiens
tttcagtagagatggtgtttcaccatgttggccaggctggtctcaaactcttgacctcatgatctgcccgcctcggcctcctaaagcgctgggattacagrcatgagccatcgcacccggccttgtatttttttattttgttttgttgttttaatttgcttttgttttagccattttgttttttcttttttttttttttga

SEQ ID NO: 80624 - DNA, 201 bp, Homo sapiens
ccaaatgaagggaggccctgcctggaatggggcttcgaatagtaccgaggggcgcccaggcattgtgcggggcagaatggggtgcgggagggccgggggtygaacccacttccggtcccctagccgggtggccgggtccacgcagacccaagtgcgcgtctgtgtgagcgctcaggccctgccttcacccgcggagccccc

SEQ ID NO: 80625 - DNA, 201 bp, Homo sapiens
ggcctcttggtggatagcacctatccttatagccaccctgaatccttgacaagcaacttaacccactgccaaggctttgcatgtgccgttccgtctgcctrtcgcgccttcctatccgctgtgatgatccattctctagaacagcacgtccatcccccgaccctagccctgtccatcacagggcgtctgaacccgcagggc

SEQ ID NO: 80626 - DNA, 201 bp, Homo sapiens
cctcagtttccccatctgtaacaggggtgatgaaaagcctgtttactggccgggcgcggtggctcacacctgtaatcccaacactttggaaggcagaggcrggaggactgcttcagcccaggagtttgggaccaacctgggcaacatagcaagaccccacctctattggaaaaaaaaaaaaaaaggctgggcaaggtggct

SEQ ID NO: 80627 - DNA, 201 bp, Homo sapiens
gatgaaaagcctgtttactggccgggcgcggtggctcacacctgtaatcccaacactttggaaggcagaggcgggaggactgcttcagcccaggagtttgsgaccaacctgggcaacatagcaagaccccacctctattggaaaaaaaaaaaaaaaggctgggcaaggtggctcatgcctgtaatcccagcactttgggag

SEQ ID NO: 80628 - DNA, 201 bp, Homo sapiens
aagaataaaatgtatttgttcattcaatacaaggtcctctgatacttctcaaagagaatttgaagtggattttgaagaatatatagatgttaggccgggcrcagtggctcatgcctgtaatcctagcactttgggaggctgaggtgggtggatcgcctgaggtcaggagtttgagaccagcctggcaaacatggtgaaacc

SEQ ID NO: 80629 - DNA, 201 bp, Homo sapiens
caaacaaaatattcacatctttttgtcttttggaagcaactttcaactggtggttattattcacgtcttgatcattgtcttgactcccatccatccaagtytcccccagcaccaggctctgagcttgctactcattgattcctccagggaccctatgtcactgggccattttccaaatgagaaaactgaggcacagagggg

SEQ ID NO: 80630 - DNA, 201 bp, Homo sapiens
ttcctccctgcaggctgaggtcctggacatcctctggatcctcctgtcagtcatcttcgtcccagcccgagcggggtcccagcccatctctcctgaatacyatcagcctggacacaatgcccaagtttgccttctcatcagaggatgagggggtaggcccaggccctgcaggccccaagaggcccgtcttcattctagggg

SEQ ID NO: 80631 - DNA, 201 bp, Homo sapiens
cctcccgagtagctgggaatacaggcaccagccaccacacccggctaatttttgtgtttttagaagagatggggttttgccatgctggccagactggtctygaactcctgacctcaggtgatcctcccttcttggcctcccaaagtgctgggattacaggtgtgagccactgcgcccggcccatttttctggttctgtgtt

SEQ ID NO: 80632 - DNA, 201 bp, Homo sapiens
tgttcatccttcaaagctcagacccaacagaaacagtcaatgtctgctagaggatgggtgttggaagctggccttttttttttttttttttttttgagacrgagtctcgctctgtcgcacaggctggagtgcagtggcgcaatctcggctcactgcaagctccgcctcccgggttcacgccattctcctgcctcagcctcc

SEQ ID NO: 80633 - DNA, 201 bp, Homo sapiens
ccaagaatctagggcgtgtgtcggccgccccctggctggatttcctgtgtgtctgggctcaggaggccacagcatccctcaggcttcagaaggagaaaccraggcaccaagtgtggcagacccttgtctggggttccccagcaagttgggcctcctgggtgtccgtccctgaccaggcatggggccccatctgttacccag

SEQ ID NO: 80634 - DNA, 201 bp, Homo sapiens
cgactccagccccagctcatcccccatgatgctgtgtgacccactgggcactctggtgagggagctttccagacatcaacagcccactctgcttccctttytgagtcccctgtccagcactgcctagtgttggagggtagaccaaggctgtgcatgattcaccccctccttccatcctggagctggcagtgaataaaagcc

SEQ ID NO: 80635 - DNA, 201 bp, Homo sapiens
tctactaaaactccaaaaatttagccgggcatagtggtgcacgcctgtaatcccagctacttgggaggcttaggcacgagaattgcttgaccctgggaggyggaggttacagtgagccaagatcgtgccactgcactccggccggggtgacagagcgagactctgtctcaaaaaaaaaaacaaaacaaaaaacaaaaaatt

SEQ ID NO: 80636 - DNA, 201 bp, Homo sapiens
actgcactccggccggggtgacagagcgagactctgtctcaaaaaaaaaaacaaaacaaaaaacaaaaaattgcagagatggggtctccttatgttgcccrccctggtctcgaactcctggcctcaaacaatcctcctgtctcagcctcccaaagtgctggaattataggtgtcagccactgcacccagcctggaagctgg

SEQ ID NO: 80637 - DNA, 201 bp, Homo sapiens
catcacggcaggtaatgcccaaggcccctctcacctttgtctgtctgcacccattttcaccaacagggtgggggcccttcctgagttggggaggctggggrtgagccccagaagaggggaggaggagtaggacacatggagagctggggagatggtgttcccagtagagggcactgcacgtgcaaaggcctggtggggtga

SEQ ID NO: 80638 - DNA, 201 bp, Homo sapiens
ggttctttttttcttttctttttcctttttttttttttttttttgagacagagtcttgctctgttgcccaggctggagtgcagtggctcaatctcggctcmctgcaacctccacctcccgggttcaagcgactgtcctgcctcagccccctaagtaactgggactacggcgtgcaccatcatgcccagctaatttttatat

SEQ ID NO: 80639 - DNA, 201 bp, Homo sapiens
caggtgccagggaaggatgcacccagcagaggaaacatcatggacaaatggggctagacaggagggtgggaaaactgagaagaggccaggcgcggaggctyacgcctgtaatcccaacactttgggagcccgaggcaggaggatcactgagcccaggagtttgagaccagcctgggcaacacagggagaccccatctgtac

SEQ ID NO: 80640 - DNA, 201 bp, Homo sapiens
ggtgatgggaagccaggtcgggagtggtcagggaaggcacgggctgagctgcagatcagagacacccggtctctggccgcgcgggggtggggcagaactgraggcgctgaggccagaggcaagagtgggggacttgggcggaaaggagggggcggggcgggattggcgagcagcgtggtgttggtgggggggcagtcccgc

SEQ ID NO: 80641 - DNA, 201 bp, Homo sapiens
gtgttctggtgtcaatcagggggctggatggggcaagaatgggggacaagggtggctttgtaaatagcagcaaatccctgcaactaatttattactttttyttttttttttttttttttgagacagagtctcactctgttgcccgggctggagtgcagcggcgtgatctcagctcactgcaacctccgcctcccaagttca

SEQ ID NO: 80642 - DNA, 201 bp, Homo sapiens
gcaggaagccaggaaggagcatggaatgaaagtctaagtgtaccaggtgtggtggctcatgactgtagtcccagctactcaaggaggctgaggcagaaggwtctctctctctctctcttttttttttttttgagaaagaatcatgctctgttacccaggctggagtccagtggcgcaatctcggctcactgcaacctccac

SEQ ID NO: 80643 - DNA, 201 bp, Homo sapiens
tcagaggctcagcctagcttcatcctgccttttgcagacagggtcccttgaagaacccctttggagaccctgatttccaaaatgaagccacaaggagggtrggatgtgggctgctcagctgaggccacacagcacagtgggatatgaggaccccacatccctcttcaaagacccttggccatcaccacttgccaggggtgt

SEQ ID NO: 80644 - DNA, 201 bp, Homo sapiens
atccctcgccgacccgattgcactcggctacctctggaaacgctcggctgtctcgggggcaccctctagtccaccagtcccgcgggattacgttcggctayttccggaaacactcgggtgcccccttacctcaggctccgcctcggcctcggttcatccgcccggctcgaatgcgctcgggcatttccgccgggggcgggc

SEQ ID NO: 80645 - DNA, 201 bp, Homo sapiens
gctgggattacaggcacatgtcaccacgcccggctaatttttgtatttttagtagagacggggtttcgccatgttggccaggctggtatcaaactcctgayctcaggtgatccgcccacctcggcctcccaaagtgctagaattacaggcgtgagccaccgcgcccagccaagaaggatctcttgagcccaggagtttgag

SEQ ID NO: 80646 - DNA, 201 bp, Homo sapiens
ctcacacctgtaatcccaacactttggaaggcagaggcgggaggactgcttcagcccaggagtttgggaccaacctgggcaacatagcaagaccccacctytattggaaaaaaaaaaaaaaaggctgggcaaggtggctcatgcctgtaatcccagcactttgggaggccaaggcgagcagatcacttgaggtcaggagtt

SEQ ID NO: 80647 - DNA, 201 bp, Homo sapiens
tttagtagagacggggtttcgccatgttggccaggctggtatcaaactcctgatctcaggtgatccgcccacctcggcctcccaaagtgctagaattacargcgtgagccaccgcgcccagccaagaaggatctcttgagcccaggagtttgaggctatagtgagccatgatcacgagaccctatctcaaaaataaaaata

SEQ ID NO: 80648 - DNA, 201 bp, Homo sapiens
aacagcccgagtggtcagtgctattattagttccacttttcaaaggaagaaactgaggcccaaagagggaagtacccaccaggaagccagagaaattctarccaatctggcacgtgaaggtgttgtcttcatcagccccagtttggggtctcttttgactggaaaccttgttaatggtccaggagcaccccagccaatcag

SEQ ID NO: 80649 - DNA, 201 bp, Homo sapiens
ctcctaaagcgctgggattacagacatgagccatcgcacccggccttgtatttttttattttgttttgttgttttaatttgcttttgttttagccattttkttttttcttttttttttttttgagacagagtctcgctctttcgcccaggctggagtgcagtggcgcgatctctgctcactgcaagctccgcctcccgggt

SEQ ID NO: 80650 - DNA, 201 bp, Homo sapiens
cctgccaccacacccggctaattttttgtatttttagcagagacgggctttcaccgtgttagccaggatggtctccatctgctgacttcgtgatcctcccrcctcggcctctcaaagtgctgagattacaggtgttagccactgcgcctggccttttttttttgaaacggagtttcactctttcgctcttcttgcccaggc

SEQ ID NO: 80651 - DNA, 201 bp, Homo sapiens
cacgtcttgatcattgtcttgactcccatccatccaagtctcccccagcaccaggctctgagcttgctactcattgattcctccagggaccctatgtcacygggccattttccaaatgagaaaactgaggcacagaggggttaagtcacttgtcgggtcacacagtgcaggagtgggggagccagactgggaacctaggac

SEQ ID NO: 80652 - DNA, 201 bp, Homo sapiens
ggaggttgcagtgagccaagattgcaccactgcattccagtctgggcgacatagccagacgctgtctcaaaaaaaaaaaaaaaaaaaaaaaaaaaaaaaawattcccacaactattggaaggggaagaaggagaccctaatggccacggtgatggtggtgatggttccatcaccatgactgcttgaactaaacgccgtgag

SEQ ID NO: 80653 - DNA, 201 bp, Homo sapiens
taattccagctactcgggaggctgagcgcaggagaattgcttgaatccaggaggcggaggttgcagtgagccgagattgctccactgcacttcagcctggscaacagagctggacttttgtctcaaaaacaaaaaacaaaaaaacacaaatatatatatatatatacttgtgtgtgtgcgtgtgtgtgtgtgtgtgtgtgt

SEQ ID NO: 80654 - DNA, 201 bp, Homo sapiens
aaccaaaatatatccacaaaggcagggggcggtagctcacacctgcaatcccagcctttcgggaggccaaggtggatggatcacttaaaggtcaggagttygagaccagcctggccaacatggtgaaacccccgtctctactaaaaatgcaaaaattagctgggagtggtggcgggtgtctgtaatcccagctactcagga

SEQ ID NO: 80655 - DNA, 201 bp, Homo sapiens
gcatacttacactgaaaaaacattcattgtttatggaaatttaaatttaactgggtgtttgctttggaaaacagcctggttgtcttttacaaatttaaaayatagagttgctgggcgcagtggctcatgcctgtaatcccagcacgttgggaagccaaggcaggaggatcgcttgagcccaagattttgagatcagcctgg

SEQ ID NO: 80656 - DNA, 201 bp, Homo sapiens
gttttagtgttttggccaggcaaaacaccaaaactctttggcctgcaatcccagaactttgggaggctaaggtgggtgaatcacctgaggccaggagttcragacaagcctggccaacatggtgagacctcatctctaccaaaaatacaaaaaatcagcctggtgtggtggtgggcacctgtagtcccagctactagggag

SEQ ID NO: 80657 - DNA, 201 bp, Homo sapiens
agcaacacttcatctcaaaataaataaataaagaaataaatctatgcaaaaagttgtatgccaatgtttatagcagctctattcagaatagctaccaaaaygtgaaaaaatccaagtgaccaccaacaaatgagtggatcaacaaaatgtacatgtacatatatacaatggaatattatttggtcatgaaacggaatgaag

SEQ ID NO: 80658 - DNA, 201 bp, Homo sapiens
aagttttggtgttttggccatatgcggtggctgacacctgtaatcccaacactttgggaggcctaggcagaaggatcttttgaggccaggagttcaagacsagcctgggcaacatagtgagatccccgtctctaaaaataaaataaaaaataaaagttttgatgttttgttcatcataaatgttttcattaattttatgtt

SEQ ID NO: 80659 - DNA, 201 bp, Homo sapiens
cggccaccttttttttttttttttttgagacggagtctcattctgtcacccaggctggagtacaatggtgtggtcttggctcactgcaacctccgcctccsgggttcaagggattctcctgcctcggcctaccgagtagctgggactacaggcgcctgccaccacatccagctaatttttgtattttaagtagagacgggg

SEQ ID NO: 80660 - DNA, 201 bp, Homo sapiens
ttttgtaatcccggcattttgggaggccaaagtgggtggatcatctgaggtcaggagttcaagactagcctgggtaacatggcaaaaccctgtctcttctaaaaaaaaaaaaaaaagtcccagctactctggaggttgaggcaggagaatcgcttgaacctgggagacagaggttgcagcgagccgagattgtgtcattgc

SEQ ID NO: 80661 - DNA, 201 bp, Homo sapiens
aacaccacacctggctaatttttttttcttttttgagacggaatctctcattgttgccaggctagagtgcaatggcaccatctcagctcactgcaagctcygcctcccaggttcaagcgatcctcccgagtagctggggctacaggtgtgcaataccacgcccagctaatttttgtatttttagtagagacagggtttcac

SEQ ID NO: 80662 - DNA, 201 bp, Homo sapiens
ttctcctgcctcagcctcccaagtagctgggattacaggcacacaccaacactcccggctaatttttgtattttcagtaaagatggggtttcaccatgttrgctaggctggtctcgagctcccgacctcaagtgattctcccgccttggcctctcaaagtgctgggattacaggcatgaaccaccaagcctggcctaatgt

SEQ ID NO: 80663 - DNA, 201 bp, Homo sapiens
caggagaaaggatgttaccttctgatggccagcaggcagcctgggccttgaggggtggtgctgggttcctggccacagcactgacggtgaactcatggctytgatccccaccactctctaccagtcaagctcatcctcccgggaacgtctccaccagcttcccttccagccgacgccggacgagctgcacttcctgtccaa

SEQ ID NO: 80664 - DNA, 201 bp, Homo sapiens
agctggacttttgtctcaaaaacaaaaaacaaaaaaacacaaatatatatatatatatacttgtgtgtgtgcgtgtgtgtgtgtgtgtgtgtgttaaccayagaaaaactgcattcattcattcagtcagtccagtcagtcactcaataagcactccttcttgcccactgaggggttgttcaggaggcagttcagtgtagg

SEQ ID NO: 80665 - DNA, 201 bp, Homo sapiens
tgcactccagcctgggcatcagagcaacacttcatctcaaaataaataaataaagaaataaatctatgcaaaaagttgtatgccaatgtttatagcagctstattcagaatagctaccaaaacgtgaaaaaatccaagtgaccaccaacaaatgagtggatcaacaaaatgtacatgtacatatatacaatggaatattat

SEQ ID NO: 80666 - DNA, 201 bp, Homo sapiens
ccgacctcaggtgatctgccggcttcggcctcccaaagtgctgggattacagttgtgagccactgcgcccggcaaatgaactcatttttaaaactctcacrcaagtacagtatatactgctgtttaggttttcctatggacttaaatatataaatgttttgctacatcatagtgtcttatgcaccagctgtatgaagtcgc

SEQ ID NO: 80667 - DNA, 201 bp, Homo sapiens
ttgatgcaattctacagtacctcatggacagtcaggcccagtgacccttcctagggtcccctcgagcctgaaagcatactccagtgtccacactgtacagyggggcagccgaagacaactgcggctgcagagaaagtgcgagtcccagggaaagaaaaaatgcaggtgctaagccaggcacagtggctcatgcctgtagtc

SEQ ID NO: 80668 - DNA, 201 bp, Homo sapiens
accctccccgctgagatagaacaaactggggaccttttgcaggaggtaaagcgaggaggatgcataggcattgggcataacctaaggggcgggcggggggygggggtgccccgggcctcatgactacatccgcccttctcccaggcggcgactgcgccacgctcctgaagaacatgggcccgctgcccgtggacatggccc

SEQ ID NO: 80669 - DNA, 201 bp, Homo sapiens
gcactttgggaagctaaggcgggcagatcacttgaggccaggagttcgagaccagtctggccaacatggtggaaacccccccccctactaaaaatacaaarattagctaagtgtggtggcgcatgcctgtaatcccagctactcaggaggctgaggcacaagaattgcttgaactcaggagatggaggttgcagtgagctg

SEQ ID NO: 80670 - DNA, 201 bp, Homo sapiens
caggtggcacccacgaagtgaagcagcacccctttttcctggccctggactgggcagggcttctccgacacaaagccgagttcgtgccccagctcgaagcygaggatgataccagctactttgacagtaaggagggatccccctggagggggggcggggggtgctctgccatccctcagtccctgggggcagagggctgtg

SEQ ID NO: 80671 - DNA, 201 bp, Homo sapiens
gcttccagtaccgcgctctgtacccgttccgccgggagcggccggaggacctggagctgctgcccggcgacgtgctggtagtgagccgggcggccttgcakgcgctgggcgtggccgagggtggcgagcgctgcccacagagcgtgggctggatgcccggcctcaacgagcgcacacggcagcgaggtgacttccctggca

SEQ ID NO: 80672 - DNA, 201 bp, Homo sapiens
ggctggagtgcagtggtgcgatttcgactcaccacaacctctgcctcccgggttcaagcgattctcctgcctcagcctcccaagtagctgggattacaggygcttaccactactgcccagctaatatttgtatttgtagtagagatggggtttcaccatgttggccaggctggtctcaaactcctgacctcaagtgagcca

SEQ ID NO: 80673 - DNA, 201 bp, Homo sapiens
ttggcctctcaaagtgctgggattacaggcgtgagccaccgcacccggccccacaactttttagggacacagctggtgttgatccccagatatctgctctrccgcccaagcctcccgtggtccttaaacacaccaggcactgtcccacctcagagcctttgccctggcagtgaccctatcctgagatgccctccccgtatt

SEQ ID NO: 80674 - DNA, 201 bp, Homo sapiens
cttcgaggggtagattattctcctcccatcgtgacagcttggttttctgagcgcagagcagctgaagtcaggcctggggtaacgccacacccccgcgaccyttccccgcctctcccgggagaccttgccctcccagctgggtcatccggcagcccagcagcttccggccccctccaattggctgtaggggccgatggcgtc

SEQ ID NO: 80675 - DNA, 201 bp, Homo sapiens
cacctgaacccaggaggcagaggttgcagtgagccgagatcaccccactgcactccagcctgggtgacacagtgagaccatctcaaaaaaaaaaaaaaaargaaagaaagaaagaaagaaatacacaagcagccaggtgcagtggctctcgcctataatcccagcactttgggagcccgaagtgggagggtcacttgaggc

SEQ ID NO: 80676 - DNA, 201 bp, Homo sapiens
aaccctgtctcttctaaaaaaaaaaaaaaaagtcccagctactctggaggttgaggcaggagaatcgcttgaacctgggagacagaggttgcagcgagccragattgtgtcattgcactccagcctgggcaacaagagcaaaagtctgtctcaaaaaaacaaaaacaacaacaaaaaaaaaccctcttgggcagcccatgt

SEQ ID NO: 80677 - DNA, 201 bp, Homo sapiens
aagtctgtctcaaaaaaacaaaaacaacaacaaaaaaaaaccctcttgggcagcccatgtctgaggatggactgtgaggtcacagtggaacacaagctcasggctttctatccttcatgcggtgagggcacccagagttggtgcaggtcagtttgctgagctctaaaagggtcttcaaaagggagtcacccgtcagccgtc

SEQ ID NO: 80678 - DNA, 201 bp, Homo sapiens
agctgacgaatggtggacccagtgacgagtggcccttgtaagggtcatggaataatttgaagcgaggcatgagcggcccctgtggtcgcctgtgactgctrgagatagaggtcccagcaccccaagccaacccagcggaccctcccagccctgcttcaaccaatggggccagtggggctccaagcagccacctaaccatcc

SEQ ID NO: 80679 - DNA, 201 bp, Homo sapiens
cccagcctaaaatattttttaatgcaggtatggtaggagccgggtggggaattagactgtgaatctggagggcctccaggaagaaaggatgttgagttcaratctggagtatgagctgcagttaattagggccagaagggagggaaggctgttctgagagagcgcacagatagcgcaaaggccttgaggcagggctgagcc

SEQ ID NO: 80680 - DNA, 201 bp, Homo sapiens
gatgtggagacagccaggtgagcgtgcattgaggggttggcaggaagttttgcagaaacctgtgggtttcacttttgcttctgcagctcaggctgggagamaatcactgtgactgttgacatctgtggcttcagtttcccagtctggaaaatgggctcagctggtcattcccaactctggggcttgttggaattggcagat

SEQ ID NO: 80681 - DNA, 201 bp, Homo sapiens
gaaaatcatctctcagctaggcacggtggctcccgcctgtaatcccagcactttggaaggctgaggcaggcagatcacttgaggccagaagttcaagatcmgcctggccaacatggtgaaaccccgtctctactaaaaatacaaaaaaattaaccaggcgtggtggtgctcgcttgtaatcccaggtactcaggaggctga

SEQ ID NO: 80682 - DNA, 201 bp, Homo sapiens
agcagatggtgcggggaccgaagggtccgggagtggtgccaggagagttctgtgtggtccagcttccccgggagcctttgcagggagctgccgattttgcytcacctctctctgccactttaaaaaaacatcttcaggccaggcacagtggctcatgcctgtaatccagcgttttgggaggccgagatgggaggactgctt

SEQ ID NO: 80683 - DNA, 201 bp, Homo sapiens
gctgtacactgggccctgctgaagccagaggggatacagacaattcaatctcagagcaatggttgaagttttgtactcaggagagagctcaaccagagaawgagacagaggtgctgggggtggctttatcctgaagatctggggcctcttggaggaagtgacctttgagcttagatctggaagaagaggaggagctggcag

SEQ ID NO: 80684 - DNA, 201 bp, Homo sapiens
aaacatcttcaggccaggcacagtggctcatgcctgtaatccagcgttttgggaggccgagatgggaggactgcttgaggtcaggaggtcaagaccagccwgaccaacatggtgaaatcctatctctactaaaaatacaaaatcagccaagcgtggtggtgggcgcctgtaatcccagcttacttgggaggctgaggcaga

SEQ ID NO: 80685 - DNA, 201 bp, Homo sapiens
ttcgccaagacaggtgccggattcccaagcggctcagggcactccctgctgaattggcctggactcctgggtggtgacctcagggagaaagctcctccctytaaaacacacgcacacccaaggctgagaggccaccaacgagagccctgtgaattgagattaaccaaagtggcgccgggagaaaagaaccagggtgactga

SEQ ID NO: 80686 - DNA, 201 bp, Homo sapiens
ttttttgtatttttagtagagatggggtttcaccatgttggccaggctggtctcaaactcctgacttcaggtgatccacccgccatggcctcccacaatgmtggaattacaagcgtgagccactgcgcctggcctgatctttatatttttagtagagacagggtttcaccatgttgaccaggctggtcttgaactcctgac

SEQ ID NO: 80687 - DNA, 201 bp, Homo sapiens
ccccttgcagtgttctctcctttctcttcccttctcagccttggtatttgaaattatcttttttttttttttttttttttttgagacggagtctcgctctrtcacccaggctggagtgcattggtgtgatctcggcccactgcaacctccacctcccgggtacaagtgattctaccacctcagcctccagagcagctggga

SEQ ID NO: 80688 - DNA, 201 bp, Homo sapiens
attacaggcatgagccactgcgcccggccaccttttttttttttttttttgagacggagtctcattctgtcacccaggctggagtacaatggtgtggtctyggctcactgcaacctccgcctccggggttcaagggattctcctgcctcggcctaccgagtagctgggactacaggcgcctgccaccacatccagctaatt

SEQ ID NO: 80689 - DNA, 201 bp, Homo sapiens
gtgagaggcacagaggcaacccctcaccatccctcccgcagagcggcaacaagatatccctgcggaccacagccctggagaacacctccatcaaggtgggycccgcccggaagaatgtggccaagggccgcatggcacgcaggagcaagaggagccgtcggcgggagacccaggatcggtgcgcggcagtgaccaccaggg

SEQ ID NO: 80690 - DNA, 201 bp, Homo sapiens
ctggccaacatggtgaaactccgtctctactaaaaatacaaaaaaattagctgggcgtggtggtgcaacacctgtaatcccagcttctcgggaggctgagrcaggagaatcgtttgaacccaggaggcggaggctgcagtaagctgagactgcgccattgcattccagcctgggcaacgagagcgaaactctgtctcaaaa

SEQ ID NO: 80691 - DNA, 201 bp, Homo sapiens
attcaagcagtcagagagaccttcgaggggtagattattctcctcccatcgtgacagcttggttttctgagcgcagagcagctgaagtcaggcctggggtracgccacacccccgcgacccttccccgcctctcccgggagaccttgccctcccagctgggtcatccggcagcccagcagcttccggccccctccaattgg

SEQ ID NO: 80692 - DNA, 201 bp, Homo sapiens
tagtacagaaagggttcctccctgttggtcaggctggtctcaaactcctgatctcaggtgatctacccacctcggcctcccaaagtactgggattacaggygtgagtcaccatgcccgacctaatttttgtgtttttagtagagacgggtttcaccatgtttaccaggatggtctcaaactcctgacctcaggtgatccgc

SEQ ID NO: 80693 - DNA, 201 bp, Homo sapiens
tggccaaggaccccctggagggtaagccgggatgggaagaggaaaccaaggctgggaaaggccggatggaggccaggcacggtggctcacacctttaatascagcactttgggaagctaaggcgggcagatcacttgaggccaggagttcgagaccagtctggccaacatggtggaaacccccccccctactaaaaataca

SEQ ID NO: 80694 - DNA, 201 bp, Homo sapiens
tggccaacatggtgagacctcatctctaccaaaaatacaaaaaatcagcctggtgtggtggtgggcacctgtagtcccagctactagggaggctgaggcaygagaatagcttgaacccaggaggcaggggttgccgagatcatgccactgcattctagtctgggcaacagagagactcgtctcataaattaaaaaaaaaaa

SEQ ID NO: 80695 - DNA, 201 bp, Homo sapiens
ctgggcgacatagcaagactccatctctacaaaaagtaatttttttttttcttttttgagacagagtctcgctctctcgcccaggctggagtgcagtggcrcgatcttggctcactgcaagctccgcctcctgggttcacgccattctcctgcctcagcctcccgagtagctgggactacaggcgcccgccaccacgcccg

SEQ ID NO: 80696 - DNA, 201 bp, Homo sapiens
acctcatctctaccaaaaatacaaaaaatcagcctggtgtggtggtgggcacctgtagtcccagctactagggaggctgaggcatgagaatagcttgaacycaggaggcaggggttgccgagatcatgccactgcattctagtctgggcaacagagagactcgtctcataaattaaaaaaaaaaaaaaaaagttttggtgt

SEQ ID NO: 80697 - DNA, 201 bp, Homo sapiens
gggtttcactgtgttagccaggatggtctcgatctcctgacctcatgatccgcccgcctctgcctcccaaagtgctgggattacaggcgtgagccaccgcrcctggcctacaaaaagtatttttaaaaattagccaggcgtggcggtgaatgcctgtagtcccacctacttgagaggctgaggtgggaggattgcttgagt

SEQ ID NO: 80698 - DNA, 201 bp, Homo sapiens
tgtaatcccagctacttgggaggctgaggcaagagaatcacttgaacccaggaggcagaggttgcagtgagctgagattgtgccactgcactccagcctgrgtgacagagcgagactccatctcaaaaaataaaaaaaagaagtgacatgtgagcagagacctgcaagaacctgagaatgagagaaagccatagagacaga

SEQ ID NO: 80699 - DNA, 201 bp, Homo sapiens
cacacctttaataccagcactttgggaagctaaggcgggcagatcacttgaggccaggagttcgagaccagtctggccaacatggtggaaacccccccccytactaaaaatacaaaaattagctaagtgtggtggcgcatgcctgtaatcccagctactcaggaggctgaggcacaagaattgcttgaactcaggagatgg

SEQ ID NO: 80700 - DNA, 201 bp, Homo sapiens
ggaggccaaagcaggcggatcacttgaggtcaggagtttgagaccagcctggccaacatggtgaaaccccaactctactaaaaatacaaaaattagccagrtgtggtggcacatgcctgtagtcccagttacttagggggccgaggcacgagaatcatttcaacctgggaggtgaaggttgcagtgagccaagatcatgcc

SEQ ID NO: 80701 - DNA, 201 bp, Homo sapiens
acggccctagatacctccctgctctgagcctcagtttccccatctgtaacaggggtgatgaaaagcctgtttactggccgggcgcggtggctcacacctgtaatcccaacactttggaaggcagaggcgggaggactgcttcagcccaggagtttgggaccaacctgggcaacatagcaagaccccacctctattggaaaa

SEQ ID NO: 80702 - DNA, 201 bp, Homo sapiens
cctcaaaccagacaagtgagctgagctagcatgagcggggcctcgcggagggcggggccagagaggatcaggggcggggccaaagaggatcagggcagagyctctgaggtgcatcccgggacccttcaggagccccatctgtctgagctctgttggtacctcctgacaggaaggcagggaatgagcgcatggtgaacatct

SEQ ID NO: 80703 - DNA, 201 bp, Homo sapiens
ctgtaatcccaacactttggaaggcagaggcgggaggactgcttcagcccaggagtttgggaccaacctgggcaacatagcaagaccccacctctattggaaaaaaaaaaaaaaaggctgggcaaggtggctcatgcctgtaatcccagcactttgggaggccaaggcgagcagatcacttgaggtcaggagttcaagacc

SEQ ID NO: 80704 - DNA, 201 bp, Homo sapiens
caagtaattctccctgcctcagcctcccgagtagctgggattacaggcacatgtcaccacgcccggctaatttttgtatttttagtagagacggggtttcrccatgttggccaggctggtatcaaactcctgatctcaggtgatccgcccacctcggcctcccaaagtgctagaattacaggcgtgagccaccgcgcccag

SEQ ID NO: 80705 - DNA, 201 bp, Homo sapiens
tagtcctagctacttgcggggctgaagtgggaagactgcttgagcccaggggtttgaggctgcagtgagctatggtcgcacaactgcactccagcctgggygacatagcaagactccatctctacaaaaagtaatttttttttttcttttttgagacagagtctcgctctctcgcccaggctggagtgcagtggcgcgatc

SEQ ID NO: 80706 - DNA, 201 bp, Homo sapiens
ctcctaccttcgctgaaaggagcttcagtgaagaccgggaggaggggtgggagcgcagcgaagtggactatggccgccggctgagtgctgacatccggtargtggcctggggaagtgtaggcagatccagcttccaagcctgctgggaggtagagacacaaaatctgatgcaaagggagcttcctagtggccaagtagaaa

SEQ ID NO: 80707 - DNA, 201 bp, Homo sapiens
cagcggccaccccagtgatgcccaagccctcgagcctttctggtaagtggggccctgagtaagagggatgatgtcatggaagtttcccagaggaggggctrtttgagatgggttttcaaggatgagtaggagttctccagagccaacaaaggctttaagagaggagaagccagggtcccagagagacccccagcccccaag

SEQ ID NO: 80708 - DNA, 201 bp, Homo sapiens
atcacttgagaccaggagttcaagaccagcctgggcaacatggtgaaacctcatctctataaaaaatacaaaaattagccgggtgtggtggcacatgcccmcaatcccagctactctggaggcggaggttgcagtgagccaagattgcaccactgcattccagtctgggcgacatagccagacgctgtctcaaaaaaaaaa

SEQ ID NO: 80709 - DNA, 201 bp, Homo sapiens
acatcaagctcacggacttcggcctgtccaagatcggcctcatgagcatggccaccaacctctatgagggccacatcgagaaggacgcccgagagttcatygacaagcaggtgggcgggcaggtgggtgggcagccccgggatgcctcctcctctctcctgggacctctcttgggctgggggctggcctcagtttccccgt

SEQ ID NO: 80710 - DNA, 201 bp, Homo sapiens
ccagcagaaaatcatctctcagctaggcacggtggctcccgcctgtaatcccagcactttggaaggctgaggcaggcagatcacttgaggccagaagttcragatcagcctggccaacatggtgaaaccccgtctctactaaaaatacaaaaaaattaaccaggcgtggtggtgctcgcttgtaatcccaggtactcagga

SEQ ID NO: 80711 - DNA, 201 bp, Homo sapiens
ggagtttgggaccaacctgggcaacatagcaagaccccacctctattggaaaaaaaaaaaaaaaggctgggcaaggtggctcatgcctgtaatcccagcaytttgggaggccaaggcgagcagatcacttgaggtcaggagttcaagaccagcctggccaacatggtgaaacctcgtctctactaaaaatacaaaaattag

SEQ ID NO: 80712 - DNA, 201 bp, Homo sapiens
aagctgtgggcagagtgttggaccgtgaatcaatgaggactgccgagggcaaagtcctggaccttggggcaggacagagccaaagactccacaagggatgwccactccctgccaccttccctgtgccccactgggtccaccggggcctcaagagggccagagtgagacacagacacccccagaccgtggggtttgcgctga

SEQ ID NO: 80713 - DNA, 201 bp, Homo sapiens
agctatgaagcctgggccccagcattgggcctggactgggtcccaaagtgtcctgtggcccaggaaggggcatccctcatgatgacactgcccctgacttrcctgggctgtcatgacaggaggaagcattaattcagtccttacggtgggagacacttctgcttccatagtgaacacatattgtaccctcagccctgttcc

SEQ ID NO: 80714 - DNA, 201 bp, Homo sapiens
gctatgaagcctgggccccagcattgggcctggactgggtcccaaagtgtcctgtggcccaggaaggggcatccctcatgatgacactgcccctgacttgmctgggctgtcatgacaggaggaagcattaattcagtccttacggtgggagacacttctgcttccatagtgaacacatattgtaccctcagccctgttcca

SEQ ID NO: 80715 - DNA, 201 bp, Homo sapiens
tggaggtaagtgacagcgcgtgtgggcggggcgcagacatcgccctggcaccccagagccttggaaaccctccagactcatcggtctcctcaagatactgyaggttggtgacatcacctctctgggcctcagtttacccctccacataatggcactgcgatacgttctaggggcttaatgggaaaattccatttttagcca

SEQ ID NO: 80716 - DNA, 201 bp, Homo sapiens
ccgcccccccatccccgcagccccgtgcgcccccctccctgtccggctccgcggggctcctggggccgatcccaccgccgaggcctcccttcccggcctcrggcggctgcggcggcacaaagggaagcagcatgtccgaccccagctactggacggcggtggcggctcccggccatcggagccgcctggcaaaaggcgcgc

SEQ ID NO: 80717 - DNA, 201 bp, Homo sapiens
ctggactcctgggtggtgacctcagggagaaagctcctccctctaaaacacacgcacacccaaggctgagaggccaccaacgagagccctgtgaattgagmttaaccaaagtggcgccgggagaaaagaaccagggtgactgagcgctccctaaccctttcctgatccctacttcccagttaagaaaactgaggctcagag

SEQ ID NO: 80718 - DNA, 201 bp, Homo sapiens
tgaggtgcaggaggctggcttcaggcccctgctttctgccacattctctctgttgtgtcctgggtaccaagagaggatcgttctcaaatggcaacttctcsaggtcctggatctcctccaggaagagttgaacaaacagtcggccctgcatagatgcttgggaagtgaacagatgatgcttagttctcctttgaggcctca

SEQ ID NO: 80719 - DNA, 201 bp, Homo sapiens
cctgggtggtgacctcagggagaaagctcctccctctaaaacacacgcacacccaaggctgagaggccaccaacgagagccctgtgaattgagattaaccraagtggcgccgggagaaaagaaccagggtgactgagcgctccctaaccctttcctgatccctacttcccagttaagaaaactgaggctcagagaggagat

SEQ ID NO: 80720 - DNA, 201 bp, Homo sapiens
ggagcagagctgttgctgggcaactgctctggtggggcgggggacggtgtcgctcccaacttccttctgtcaaggtgtgggctgaggccagggcccaggtrggagaagaagccaggcagggtgtgagagacctgggccagggatctggtggccagaagggaactgggatggaaagaggaaaacgtgggcaaaagttcagca

SEQ ID NO: 80721 - DNA, 201 bp, Homo sapiens
tcagtttcccctcctgcaaaatggagtagaacaattatcttcaaatatctgtgagagatggtgtttatgagacacttagggcaaaaaggcaatcatcctcaaaaaagaaactgacaactgcagcggctacctgcttttgtaagtaaagttttattggcaccagggccaggattaaagggaggcaaacaaggctgagtggtg

SEQ ID NO: 80722 - DNA, 201 bp, Homo sapiens
caaacccctctgcctcagcctccccaagtgctgggattacaggcataagccacacgctgggccatccacagacctttaacggggagaagagagaacaatayagagcccacatttgggtgctgggcaacagggaggtaccttccttcagacgccaagcacttatgaggcacctactgagatccaggtgctaaaggcattgct

SEQ ID NO: 80723 - DNA, 201 bp, Homo sapiens
tccatcaggctagaagcacttcatgccattgctgttaataacaacactgccaatagtttgtgtttgtttttgttattgtttttcagatgaagtttcactcrtgtcgcccaggctggaatgcaatggcactatctcagcccactgcaacctccgcctcctgggttcaagtgattctctgccccagcctcctgagtagctggg

SEQ ID NO: 80724 - DNA, 201 bp, Homo sapiens
gcatcaccacgcccagctaattttgtatttttagtacagaaagggttcctccctgttggtcaggctggtctcaaactcctgatctcaggtgatctacccayctcggcctcccaaagtactgggattacaggcgtgagtcaccatgcccgacctaatttttgtgtttttagtagagacgggtttcaccatgtttaccaggat

SEQ ID NO: 80725 - DNA, 201 bp, Homo sapiens
catgatgaagggagggacccgtgtgttggaggccgctgagcagatttgaccagttttaactgggaggggagggaggaagtatctgggactgagaaaggccrtaaggctgcctcactcaccaccggggggcagcagagccacattgccttgggcctggcgggggaatgggtccctgcctgccatgttccaagcatcctagga

SEQ ID NO: 80726 - DNA, 201 bp, Homo sapiens
cctcagcaggcagcagccccttggatagtcctcggaatttctcggctgcctctgccctaaatttcccctttgcccggaggtgagtgattgccggctttggkagacagtgcgggcaccacgggcaggggttgggcaggggcacgtgctcggtggctagacctggctcctcattcatttcattcaccttttcccctcccctgg

SEQ ID NO: 80727 - DNA, 201 bp, Homo sapiens
aactcctgacctcaggtgatccacccgccttggcctcccacggtactggaattactggcatgagccattgtgcctggccttgcaacttccctgcttccatyctatccatctccccgtcgctcacttggctccagccacatggctgatcctccagaatgcaggctggtccagcctcagggcctttgcacttgctgtccccac

SEQ ID NO: 80728 - DNA, 201 bp, Homo sapiens
ccgagtgtgtgcaaaggtgtgtccccgtgcatatggggtggctcagcacgtagtgacagcaagtggagactgtggccccatccccacttgggtccccagaytcaagagaatctgcaccccgcatgaggcttgggctgcatacctgggggtcataggtgaccactcccatactcatcaccatctctggtggtctcaaaacca

SEQ ID NO: 80729 - DNA, 201 bp, Homo sapiens
acaacattcattaagcacccactgtgtgtatgctctgtgctgcgggctgagggcatggtcgcaaatgggcagctggccctgagcccctggggagtcctccrtttggtggggggtggtcaatgtgtgccccagaagctacagctcagaggttgaagctttgacaggggacacagtggcagctggagtcacggggggggcttc

SEQ ID NO: 80730 - DNA, 201 bp, Homo sapiens
cctcccagacaccgtcccagacccttactggcctcctgctaccttcattcctgtcccccagcagtctgctccccatagcagacacaagggggtttacaaaygtagtccacatcataccctttctctgctcaagcaccctccatggctccccattgctcctacaatacaattgcactcctccctgcagcccacaaggcttat

SEQ ID NO: 80731 - DNA, 201 bp, Homo sapiens
taggcagaagaacagttattaggcaatgactgtgtacctggcccagaacactttatctttatttatttatttattttttgagacagggacagtctttgtckcccgggctggagtacagtggcgcagtcttggctcactgcaacctccgcctaccgggttcaagcaatattcctgcctcagcttcccgagtagctgggatta

SEQ ID NO: 80732 - DNA, 201 bp, Homo sapiens
gccccagcctcacctgctgatggaggactcaatggcccagtgacctgacaccacaccaccaactccctcccaccagctgacgaatggtggacccagtgacragtggcccttgtaagggtcatggaataatttgaagcgaggcatgagcggcccctgtggtcgcctgtgactgctggagatagaggtcccagcaccccaagc

SEQ ID NO: 80733 - DNA, 201 bp, Homo sapiens
aggaggcagtgttcaaactgaggcctggagggcaggaggtgaccaggttgcagatccaaaggaaagagtgaaacaggcagcataggcatagaccctaaggwtggaccatacctggagtgggactgacctgccactgtccccattgaaagctggggaggcccggcatggtagctcacacttgtaatcccagcactgtgggag

SEQ ID NO: 80734 - DNA, 201 bp, Homo sapiens
aatcccagccactcgggaggctgaggcaggagaatctcttcaactcaggtggtggaggttgcagtgagccaagatctcgccactgcactccagcctgggcracagagtgagactgcgtctcaaaaaataaaaatacaaatacaaaaattagctgggcatggtggcacacgcctgtaatcccgtctacttgggaggctgaga

SEQ ID NO: 80735 - DNA, 201 bp, Homo sapiens
tcccttcccggcctcaggcggctgcggcggcacaaagggaagcagcatgtccgaccccagctactggacggcggtggcggctcccggccatcggagccgcytggcaaaaggcgcgctgctgcagcgctccaagaggtagggggcacggcgccggcgaaggctcggcggccagccgagcaaacaggagttgccagaagtgtg

SEQ ID NO: 80736 - DNA, 201 bp, Homo sapiens
agggggtgctgaggtggtgcgacgctggccccagcctccaggcatctggtatctccagggcccaggcctgcgtcctgcctcggcctgaaggagcaggaggyggccccgtctgggctcccagccagaatctgcctctccccctggtaacagccacctccctcctctgcctggcctctgtccagccaccatacacggccccac

SEQ ID NO: 80737 - DNA, 201 bp, Homo sapiens
gagggagcgattagatttacattttagcagaaaggagccaaaatgcctgcccctagctcgaggttaaggtgctgccaacgccccgcccccgccgcccgcgrtcgtagcaacgcccggcctcagccgcccgcggccctagcaacgctccgcctctccgcccgcggccatggcagcgccccgcccactcgccggcacgcgggt

SEQ ID NO: 80738 - DNA, 201 bp, Homo sapiens
cctccatgaggtctcaccctgctttggggaaccctcaggaaccccagtctggggtagggagcccagccatgggggtttagggctggaggagcccagacagragtgtgtgaggatgggaccctggaggcaagaggagggtggccatcctaggtggggggaactgatgggcagaggcctggagaccagaagtgaaggcaggga

SEQ ID NO: 80739 - DNA, 201 bp, Homo sapiens
ggagaaaggatgttaccttctgatggccagcaggcagcctgggccttgaggggtggtgctgggttcctggccacagcactgacggtgaactcatggctctratccccaccactctctaccagtcaagctcatcctcccgggaacgtctccaccagcttcccttccagccgacgccggacgagctgcacttcctgtccaagc

SEQ ID NO: 80740 - DNA, 201 bp, Homo sapiens
tggggttggtctcaggtcccatatcacaagccagctgtcttcctttcagcccgggccgtgcaacggggaccttcgacaatgagattgtcatgatgaatcaygtgtaccgggagaggttccccaaggtgggcagcgcctggcggctggaccagcccctgcacttctttccacattgctgtccctccatggaactctgtcttc

SEQ ID NO: 80741 - DNA, 201 bp, Homo sapiens
accagcccctgcacttctttccacattgctgtccctccatggaactctgtcttcctggctatgtcccctttgccagtctgttcatttctgtctttccttcyccttccgttgaaagatgtcgttcctcctgcgccagccctcccacccgatcgccccattgccccatctcctctctccccaaccatgcctctcctgccccat

SEQ ID NO: 80742 - DNA, 201 bp, Homo sapiens
aaaaaaaacaaacaactcccacagccagccaggtgcagtggctcacgcctgtaatcccataatcccagcactttgtgagactgaggcgggtggatcacttraggtcaggaattcaagactagcctggccaatatgcagaaactccatctctactaaaaacaaatattagccgggtgtggtggcatgtgcctgtagatccca

SEQ ID NO: 80743 - DNA, 201 bp, Homo sapiens
aggccggatggaggccaggcacggtggctcacacctttaataccagcactttgggaagctaaggcgggcagatcacttgaggccaggagttcgagaccagyctggccaacatggtggaaacccccccccctactaaaaatacaaaaattagctaagtgtggtggcgcatgcctgtaatcccagctactcaggaggctgagg

SEQ ID NO: 80744 - DNA, 201 bp, Homo sapiens
cacacagacagagcatgtcagacgccccgactcaatttgccaaacacaccctctatgccagtccggtgctgggagctgctgggaccctaaggagcccccarcctggggaagacatagccggacagacaggaaagcgggtttttcagaggagaggacgcagttttgccaggctagattccaagcagtggggccagggtgggc

SEQ ID NO: 80745 - DNA, 201 bp, Homo sapiens
gaaatagacccatggctcaaagtcattgcaagtgggttttgaggactgcatagcagttcgctgttgagattcttcctgatgccatcgctggtaccagcctsctgctaccctctccctgcgagtactccatcatagccctgcctttaaaagcttcctccagacatctgggccctgagctatgttttttatttttatgttttt

SEQ ID NO: 80746 - DNA, 201 bp, Homo sapiens
acttttgggaggccgaggtgggtggatcacaaggtcaggagttcaagaccagccaggacaacatggtgaaaccccatctctactaaagatacaaaaattarccgggtgtggtggcgtgtgcctgtaatcccagctactcgggaggctgaggcaggagaatcatttgaaccctggaggcggaggttgcagtgagccgagatc

SEQ ID NO: 80747 - DNA, 201 bp, Homo sapiens
gaggttgcagtgagccgagatcacgccactgtgctctagcctgggtgaaagagtgagcctacatttcaaaaaaaaaaagatgtagctgggtgtagtagtgygcgcctgtagtcccagctactcaggaggctaaggtgggaagatcgcttgagcttggcaggttgagactgcagtgagctatgatcacaccactgtcctcca

SEQ ID NO: 80748 - DNA, 201 bp, Homo sapiens
tgcggggctgaagtgggaagactgcttgagcccaggggtttgaggctgcagtgagctatggtcgcacaactgcactccagcctgggcgacatagcaagacyccatctctacaaaaagtaatttttttttttcttttttgagacagagtctcgctctctcgcccaggctggagtgcagtggcgcgatcttggctcactgcaa

SEQ ID NO: 80749 - DNA, 201 bp, Homo sapiens
ggacggcggtggcggctcccggccatcggagccgcctggcaaaaggcgcgctgctgcagcgctccaagaggtagggggcacggcgccggcgaaggctcggsggccagccgagcaaacaggagttgccagaagtgtgtcctggccgcgtggcgcggaccacggcgagcgtctgtctgtggcagcagtgggaaggggggagga

SEQ ID NO: 80750 - DNA, 201 bp, Homo sapiens
ctctacaaaaagtaatttttttttttcttttttgagacagagtctcgctctctcgcccaggctggagtgcagtggcgcgatcttggctcactgcaagctcygcctcctgggttcacgccattctcctgcctcagcctcccgagtagctgggactacaggcgcccgccaccacgcccggctaattttttgtatttttagtag

SEQ ID NO: 80751 - DNA, 201 bp, Homo sapiens
agctggtccaggggctcctggccatatgtagtgtcctccatcaggctagaagcacttcatgccattgctgttaataacaacactgccaatagtttgtgttkgtttttgttattgtttttcagatgaagtttcactcgtgtcgcccaggctggaatgcaatggcactatctcagcccactgcaacctccgcctcctgggttc

SEQ ID NO: 80752 - DNA, 201 bp, Homo sapiens
gatttgctggtgctgctggcagtagccatggtacagggaaaagtgtgggggtgggactgtgacacagaaccctgaaaagctggtccaggggctcctggccrtatgtagtgtcctccatcaggctagaagcacttcatgccattgctgttaataacaacactgccaatagtttgtgtttgtttttgttattgtttttcagat

SEQ ID NO: 80753 - DNA, 201 bp, Homo sapiens
tggcgcatgcctgtaatcccagctactcaggaggctgaggcacaagaattgcttgaactcaggagatggaggttgcagtgagctgagatcgcgccactgcrctccaacctgggcgacagagcgagaccctgtctcaaaaaaacaaaaaaagaaagggcagatgaagccaggattcaagcccaggcccatccgattccagaa

SEQ ID NO: 80754 - DNA, 201 bp, Homo sapiens
ggctggagtgcagtggcgcgatcttggctcactgcaagctccgcctcctgggttcacgccattctcctgcctcagcctcccgagtagctgggactacaggygcccgccaccacgcccggctaattttttgtatttttagtagaggcggggtttcactgtgttagccaggatggtctcgatctcctgacctcatgatccgcc

SEQ ID NO: 80755 - DNA, 201 bp, Homo sapiens
cacgcctgtaatcccagcactttgggaggccaaggcgggcagatcacctgaggtcaggagtttgagacgagcctggccaacatggtgaaaccctgtctctrctaaaaatacaaaaattaggctgggcgtagtggcttatacctgtaatcccagcactttgggaggccgaggcaggcggattacctgaggtcaggagttcaa

SEQ ID NO: 80756 - DNA, 201 bp, Homo sapiens
acccagctaatttttaaattttgtatagagacggggtcttgctatgttgcccaggctggtcttgaactcctggcttcagaggatcctcccaccttggcctyccaaagcactggggttactggcgtgagccaccatgcctggccagcagtagtgtcaataataaggaatgttagttgaggggtgattccctcctgggccttg

SEQ ID NO: 80757 - DNA, 201 bp, Homo sapiens
aaaataaagctgaggaaactgaggctccaggcagataaggctgagcagggaatcaaacccaggtgtacctaaggccagatcacatgtggtctgtggctggmccatgtttgccaggcattcgctaggggctgcccctctgccaaggcctggggcaagaacatattggaccctccacctgggctgcaccctgagctgaggaag

SEQ ID NO: 80758 - DNA, 201 bp, Homo sapiens
tcccatccttctccagaacgggctgcgagtgtgatttaggctgggcaggtggcttagcgcggggccctgggcagccacctaccctgtccccttttcccccsacagctgccgcagcgggaaccgcaagagcttggtggtaggaacgccctccccgaccctctcccggcccctgtcgccattgtcggtcccaacgggtgagtg

SEQ ID NO: 80759 - DNA, 201 bp, Homo sapiens
atagtcctcggaatttctcggctgcctctgccctaaatttcccctttgcccggaggtgagtgattgccggctttgggagacagtgcgggcaccacgggcargggttgggcaggggcacgtgctcggtggctagacctggctcctcattcatttcattcaccttttcccctcccctggcccgtctggtggtggtctccccct

SEQ ID NO: 80760 - DNA, 201 bp, Homo sapiens
tggcacaatctcggctcactgcaacctccgccttctgggttcaagccattctcctgcctcagccttccaagtagctgggactacaggcatgtgccaccacrcccagctaatttttgtatttttagtagagacgggttttcaccatgttgaccaggctggtcttgaacgcctgacctcaagtgatccgcccacctcagcctc

SEQ ID NO: 80761 - DNA, 201 bp, Homo sapiens
gagggaggaaggagctcaggggatggaatgacacgatgtagggaaaaagatgaccgggatcctggtgtctagcagggaacctgggagtacttagagacgartgcaggtgccagggaaggatgcacccagcagaggaaacatcatggacaaatggggctagacaggagggtgggaaaactgagaagaggccaggcgcggagg

SEQ ID NO: 80762 - DNA, 201 bp, Homo sapiens
tcgcttgaactcgggaggtggaggttgcggcgagccgagatagcgccattgcactccagcctgggcaacaagagcgaaactccgtctcaaaaaataataayaaaataagcaatcgtcgcgtcctttctatcctggtcttagcttgcgctctgccataaaactccctctagccgaacccggcccagccctagagcaatccgt

SEQ ID NO: 80763 - DNA, 201 bp, Homo sapiens
ggtggggggaactgatgggcagaggcctggagaccagaagtgaaggcagggagatgtatggttcaggcaggtaaagtactattaccaaagtactgccaggygagagagcgaacatgcacttaggagacaccagctgtatacagcactaattgctgccctgtcggggagaatcagaaggcagggtctcagcttggcgcgctg

SEQ ID NO: 80764 - DNA, 201 bp, Homo sapiens
gggatcagagagggggcttacatgtctaggtgatgttgttcaacagcatgggcactcaatctctgggtcagagactccctgcagggtggtagcagcttagrgtcttgaaatccacaaagttcatcttatccatggctcagagatggtgcagtttcacgagtctgcaaagcagacaggctctcagtggctaaaattttgctt

SEQ ID NO: 80765 - DNA, 201 bp, Homo sapiens
gtataaccatcatttaatgaactatgtagtcagtacctcctgtttgctccagctctgtaaagaaacaattctgtgccggcactttgggaggccgaggcagrtgaactacctgagatcaggagttcaagaccagcctgaccaacacggcaaaaccccgtctctactaaaagtacactaaaaaaatatatatatatatacaca

SEQ ID NO: 80766 - DNA, 201 bp, Homo sapiens
tcacctgaacccaggaggcagaggttgcagtgagccgagatcaccccactgcactccagcctgggtgacacagtgagaccatctcaaaaaaaaaaaaaaaragaaagaaagaaagaaagaaatacacaagcagccaggtgcagtggctctcgcctataatcccagcactttgggagcccgaagtgggagggtcacttgagg

SEQ ID NO: 80767 - DNA, 201 bp, Homo sapiens
cattcattcattcacttaacaagagctgattgagcacctgtcatgtgccagacgcttgcatttcatttatttattcatacaacaacattcattaagcaccyactgtgtgtatgctctgtgctgcgggctgagggcatggtcgcaaatgggcagctggccctgagcccctggggagtcctccgtttggtggggggtggtcaa

SEQ ID NO: 80768 - DNA, 201 bp, Homo sapiens
tgggcagctggccctgagcccctggggagtcctccgtttggtggggggtggtcaatgtgtgccccagaagctacagctcagaggttgaagctttgacaggrgacacagtggcagctggagtcacggggggggcttcctggaagaggtacctaaagagagagagcatgcagtggacttggtcagcctgtgtctctgttcttg

SEQ ID NO: 80769 - DNA, 201 bp, Homo sapiens
gaaggcagggagatgtatggttcaggcaggtaaagtactattaccaaagtactgccaggcgagagagcgaacatgcacttaggagacaccagctgtatacrgcactaattgctgccctgtcggggagaatcagaaggcagggtctcagcttggcgcgctggctcacgcctgtagtcccagcactttgggaggccgaagtgg

SEQ ID NO: 80770 - DNA, 201 bp, Homo sapiens
ccctggggagtcctccgtttggtggggggtggtcaatgtgtgccccagaagctacagctcagaggttgaagctttgacaggggacacagtggcagctggastcacggggggggcttcctggaagaggtacctaaagagagagagcatgcagtggacttggtcagcctgtgtctctgttcttggttattttcaggagatcct

SEQ ID NO: 80771 - DNA, 201 bp, Homo sapiens
ctctagaggcggagcttgcagtgagccgagactgcgccactgcactctagcctgggcaacagagcgggcaacagagtgagactctgtctcaaaaaaataawtaaaaatttaaaaaataggccaggcgcggtggccaacgcctgtaatctcagcactttgggaggccaaggctggtggatcacgaggtcaagagatcgagac

SEQ ID NO: 80772 - DNA, 201 bp, Homo sapiens
cgtctctcccatcttccggctatggaaccaacacacccagctccaccctctcggtacccatagccccaccttggcaggtggacaggcagatgccgggttgkggggggacacatctttgtgtgtttttttcaaggtgttggatagttgtgcagtcagcaaacatactagttacttcctccatgcacgccccattctgggaaa

SEQ ID NO: 80773 - DNA, 201 bp, Homo sapiens
agatcgagaccatcctgaccaacatagtgaagccccatctctactaagaatacaaaaattagctgggtgtggtggtgtgcgcctgtaatcccagctactckggaggctggggcaggagactcgcttgaacccgggaggcggaggttgcagtgagccgagatcgcgccactgcactccagcctggcgacagagcgagactct

SEQ ID NO: 80774 - DNA, 201 bp, Homo sapiens
tcggtacccatagccccaccttggcaggtggacaggcagatgccgggttgtggggggacacatctttgtgtgtttttttcaaggtgttggatagttgtgcrgtcagcaaacatactagttacttcctccatgcacgccccattctgggaaatgcagggtcccctgagaagacccagccttggccccaaaatagtccctggt

SEQ ID NO: 80775 - DNA, 201 bp, Homo sapiens
ccatcctgaccaacatagtgaagccccatctctactaagaatacaaaaattagctgggtgtggtggtgtgcgcctgtaatcccagctactctggaggctgrggcaggagactcgcttgaacccgggaggcggaggttgcagtgagccgagatcgcgccactgcactccagcctggcgacagagcgagactctctctcaaaa

SEQ ID NO: 80776 - DNA, 201 bp, Homo sapiens
tgggcagcgcctggcggctggaccagcccctgcacttctttccacattgctgtccctccatggaactctgtcttcctggctatgtcccctttgccagtctkttcatttctgtctttccttccccttccgttgaaagatgtcgttcctcctgcgccagccctcccacccgatcgccccattgccccatctcctctctcccca

SEQ ID NO: 80777 - DNA, 201 bp, Homo sapiens
catcctgaccaacatagtgaagccccatctctactaagaatacaaaaattagctgggtgtggtggtgtgcgcctgtaatcccagctactctggaggctggrgcaggagactcgcttgaacccgggaggcggaggttgcagtgagccgagatcgcgccactgcactccagcctggcgacagagcgagactctctctcaaaaa

SEQ ID NO: 80778 - DNA, 201 bp, Homo sapiens
tccctccatggaactctgtcttcctggctatgtcccctttgccagtctgttcatttctgtctttccttccccttccgttgaaagatgtcgttcctcctgcrccagccctcccacccgatcgccccattgccccatctcctctctccccaaccatgcctctcctgccccattctgcgtgtgtcactccagccccgccctctg

SEQ ID NO: 80779 - DNA, 201 bp, Homo sapiens
caacatagtgaagccccatctctactaagaatacaaaaattagctgggtgtggtggtgtgcgcctgtaatcccagctactctggaggctggggcaggagaytcgcttgaacccgggaggcggaggttgcagtgagccgagatcgcgccactgcactccagcctggcgacagagcgagactctctctcaaaaagaagaaaaa

SEQ ID NO: 80780 - DNA, 201 bp, Homo sapiens
ttcctggctatgtcccctttgccagtctgttcatttctgtctttccttccccttccgttgaaagatgtcgttcctcctgcgccagccctcccacccgatcrccccattgccccatctcctctctccccaaccatgcctctcctgccccattctgcgtgtgtcactccagccccgccctctgaccaggtcgccccgtctcgc

SEQ ID NO: 80781 - DNA, 201 bp, Homo sapiens
ctaagaatacaaaaattagctgggtgtggtggtgtgcgcctgtaatcccagctactctggaggctggggcaggagactcgcttgaacccgggaggcggagsttgcagtgagccgagatcgcgccactgcactccagcctggcgacagagcgagactctctctcaaaaagaagaaaaaattaaaaaattaaaaataaatgaa

SEQ ID NO: 80782 - DNA, 201 bp, Homo sapiens
acaggtgacagttcccatcgtgtagggctttgagaggaacacagggtgctattgggctagcgtgggcttccctaaggaggcagcgggagtggagacccagkgggtgagctgggaagggtgctccaggcagagggaacagcatgtgcagaggcctgcaggtggaaccaagccccgggtgaccagccctcctgtgcccctagg

SEQ ID NO: 80783 - DNA, 201 bp, Homo sapiens
taaggaggcagcgggagtggagacccagggggtgagctgggaagggtgctccaggcagagggaacagcatgtgcagaggcctgcaggtggaaccaagcccygggtgaccagccctcctgtgcccctaggagtttgaccctgaggaattttaccacctgctggaggcggctgagggccatgcgcgggagggccaaggcatta

SEQ ID NO: 80784 - DNA, 201 bp, Homo sapiens
ctcccggcgtgagccaggccctgtgagcattgtctaggcaaagacaacagtgtatgtacccgagtccgacccaaagctgagcactggatgtggtaggtttyatccttcaaggtagagatgaggaaacaggctcaaggggcagccacatgtggagacgtagacaggctgggcctcttctccctgcccaccttgtcacctgtg

SEQ ID NO: 80785 - DNA, 201 bp, Homo sapiens
ccctgctgaccctctagccgacacagctgctctcagccacgcccgcctacggagcaatagcatcggcgcccgacactccacaccaaggcctctggatgccrgccggggccgccgccttgggggcccaagagacccagcccctgagaagtccagagcctcctccagcggtggcagtggtggcggcagtgggggccgcgtgcc

SEQ ID NO: 80786 - DNA, 201 bp, Homo sapiens
agacgaatgcaggtgccagggaaggatgcacccagcagaggaaacatcatggacaaatggggctagacaggagggtgggaaaactgagaagaggccaggcrcggaggctcacgcctgtaatcccaacactttgggagcccgaggcaggaggatcactgagcccaggagtttgagaccagcctgggcaacacagggagaccc

SEQ ID NO: 80787 - DNA, 201 bp, Homo sapiens
aaggatgcacaggagttctccaggaactatcacaagaccttggaaagaatagaaagtagctgggtctggtgcccatatggagcactgagcctgaataagtrtgtgaggctgtaaagtcaccaggacctgtgtcaaaggcccagcccagaagatcccactgtcccagttttcccagccacctggttaatcattaagggaccg

SEQ ID NO: 80788 - DNA, 201 bp, Homo sapiens
ggcgtcctcagctggccgagcatggtggcagcctgcacccttggctcccttgtctggtgcagccagcagagccgccagccttgggcgcccatggccctccrtgtgagggcgtgagcggcctgccccagcctcacctgctgatggaggactcaatggcccagtgacctgacaccacaccaccaactccctcccaccagctga

SEQ ID NO: 80789 - DNA, 201 bp, Homo sapiens
gcccagtgggggcggggccctgtggtcgggctccccgggaggggcggggccaggccgtgtcagctgaccggcctggccaatggcacctggcggcggggcckggcaggccggggcggggccgggggcgggcctggcggcgcggactcccgggccatggacgagtcgagcctcctgcggcgccgcgggctccaggtgaggccc

SEQ ID NO: 80790 - DNA, 201 bp, Homo sapiens
tgttgttttaatttgcttttgttttagccattttgttttttcttttttttttttttgagacagagtctcgctctttcgcccaggctggagtgcagtggcgygatctctgctcactgcaagctccgcctcccgggttcacgccattctcctgcctcagcctcccaagtagctgggattacaggtgcccgccaccacgcccgg

SEQ ID NO: 80791 - DNA, 201 bp, Homo sapiens
ctgtagtcccacctacttgagaggctgaggtgggaggattgcttgagtttaggagactgaagctgcagtgagccatgatggcaccactgcactccagcctrggtgacagagcaagagcctgtctctgaaataatcatacttggccgggtgcggtggctcacgcctgtaatcccagcactttgggaggccaaggcgggcaga

SEQ ID NO: 80792 - DNA, 201 bp, Homo sapiens
agctgggtgtggtggtgtgcgcctgtaatcccagctactctggaggctggggcaggagactcgcttgaacccgggaggcggaggttgcagtgagccgagaycgcgccactgcactccagcctggcgacagagcgagactctctctcaaaaagaagaaaaaattaaaaaattaaaaataaatgaaggtagggtccgcccctt

SEQ ID NO: 80793 - DNA, 201 bp, Homo sapiens
gctgggtgtggtggtgtgcgcctgtaatcccagctactctggaggctggggcaggagactcgcttgaacccgggaggcggaggttgcagtgagccgagatygcgccactgcactccagcctggcgacagagcgagactctctctcaaaaagaagaaaaaattaaaaaattaaaaataaatgaaggtagggtccgccccttc

SEQ ID NO: 80794 - DNA, 201 bp, Homo sapiens
gtgcgcctgtaatcccagctactctggaggctggggcaggagactcgcttgaacccgggaggcggaggttgcagtgagccgagatcgcgccactgcactcyagcctggcgacagagcgagactctctctcaaaaagaagaaaaaattaaaaaattaaaaataaatgaaggtagggtccgccccttccctctcccccgaccc

SEQ ID NO: 80795 - DNA, 201 bp, Homo sapiens
gccaaggcaggaggatcacttgaagccaggagtttgagaccagcttgggcaacatactgagatctcgtctctattaaaaaaacaattagccaggcatgatsgcacatgcctatagtcctagctacttgcggggctgaagtgggaagactgcttgagcccaggggtttgaggctgcagtgagctatggtcgcacaactgcac

SEQ ID NO: 80796 - DNA, 201 bp, Homo sapiens
gagcatggaatgaaagtctaagtgtaccaggtgtggtggctcatgactgtagtcccagctactcaaggaggctgaggcagaaggatctctctctctctctyttttttttttttttgagaaagaatcatgctctgttacccaggctggagtccagtggcgcaatctcggctcactgcaacctccacctcccgggttcaagta

SEQ ID NO: 80797 - DNA, 201 bp, Homo sapiens
cccccgaccctccccgctgagatagaacaaactggggaccttttgcaggaggtaaagcgaggaggatgcataggcattgggcataacctaaggggcgggcsgggggtgggggtgccccgggcctcatgactacatccgcccttctcccaggcggcgactgcgccacgctcctgaagaacatgggcccgctgcccgtggaca

SEQ ID NO: 80798 - DNA, 201 bp, Homo sapiens
gggcgtcgtcctctatgagtttctggtgggctgcgtgcctttctttggagatacccccgaggaactcttcggtcaggtggtcagcggtgcgtttcctccaygggcccgggtttgagctgcagccccaccagagctctgggcagcggtcctccacccgcatgtcagggagagaagcaggaagaggggagggagttggatgcc

SEQ ID NO: 80799 - DNA, 201 bp, Homo sapiens
ctgagttccgaaggtaaacataacaatgggcttcttcactgtgcccaggtggaagtagagcttttgtcccggcagagcgggctctctggccgccaggtagmgcgttggttccgtcgccgccgcaaccaggaccggcccagtctcctcaagaagttccgagaagccaggtgggggaggctggggcagaagctgggtgacaag

SEQ ID NO: 80800 - DNA, 201 bp, Homo sapiens
cacaccctagtgaagagacggtttgtggaatccatggcagagggattagagtgatggaatgaagaacctcaggggctagggggtttgtggagtggggacasccttgcggctggttgctcttacctctctctcctctcccagagcactatcccttcccagtattggtactacatgattgaactttccttctactggtccctg

SEQ ID NO: 80801 - DNA, 201 bp, Homo sapiens
catgggttgatttaagagcaaagcctcgggttgattttactgccacttgacgcttcattggacctggacaggagggagaatggggtcaggacccatcccarctcatgaacagacattctatcatgaatggacattctacccctatttctctcccaacattgcagctgagaaacaccaataagctggaactcaaagatccta

SEQ ID NO: 80802 - DNA, 201 bp, Homo sapiens
gacagtctcgctgtcacctaggctagagtgcaatggcgtgattccggctcactgcaacctctgcctcctgggttcaagcgattctcctgcctcagcctccygagtagctgggactataggcgcccgccaccacacccagctagttttttgtatttttagtagagatgaggtttcgccatgttggccaggctggtctcgaac

SEQ ID NO: 80803 - DNA, 201 bp, Homo sapiens
ggggaggaggctgcagctgggggaggagcaaagagccggcccctagccaatggccaccccatcctcaataacaaccatcgtaagaatgactgaaccattaytccagctgcctcccagattaatgcataaagccaaggaactaccccgctccctgcgctatagggtcactttaagctctggggaaaaaggagaaagtgagag

SEQ ID NO: 80804 - DNA, 201 bp, Homo sapiens
ctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaa

SEQ ID NO: 80805 - DNA, 201 bp, Homo sapiens
aaaactcatttttccctcccccaagcaatcaacaagccctcctggcatggggccgtgggcccagtacttactcagaggtgccagaggtgaggtgggtgtcrttgttgtggcctggtagcttgcctgtgtgagcactgcctccggtgtggcctggtagaggaaagtgggggtgtgtgcagcctaggctgaacagccagtcag

SEQ ID NO: 80806 - DNA, 201 bp, Homo sapiens
tgaggaatcatttgttggtacaagtatgacccaaatatttcattaaatatactaacatttttttttttgaggcggagtctctctctgttgcccaggctggmgtgcagtggcattatgttggctcactgcaagctccacctcccgggttcaagcgattctcctgcctccgcctcccgagtagctgggattataggcgcctgc

SEQ ID NO: 80807 - DNA, 201 bp, Homo sapiens
acaccttcctgcccagcatctcttctcccaggaactgggcctcaatccatgtgagtgaactccactcagcctctcagcggctcagcctcaaacacaggagrcttttatgcactgccttccctgtgggtccaggtgggaccacagagacctagtctcaaagtccagcttctgacctggctctgccccagcttctgacctggc

SEQ ID NO: 80808 - DNA, 201 bp, Homo sapiens
gaggaatcatttgttggtacaagtatgacccaaatatttcattaaatatactaacatttttttttttgaggcggagtctctctctgttgcccaggctggartgcagtggcattatgttggctcactgcaagctccacctcccgggttcaagcgattctcctgcctccgcctcccgagtagctgggattataggcgcctgcc

SEQ ID NO: 80809 - DNA, 201 bp, Homo sapiens
cctggccctcggctttctgtacccttcagagtttcttctggctacctgcccagcagatttagggagaaccgaaggaagcgtgaggcctcctgtttcctcasgccgaatctctccaaggggctcctggccggcatgccaggctgaactctgaatttggagaagtccaacagagtctcagtcacatggcagaagcgaagtcct

SEQ ID NO: 80810 - DNA, 201 bp, Homo sapiens
tggaatacaggggaaaggcagccacatacaccgcctccactgttcatgcatgtccacctcttcagcctccaagtcccacattgcttttatttatttatttrttgagaccgagtcttactctgtcacccaggctggagtgcagtggtgtgatctcagctcactgtaacctctgcctcccaggttcaagtgattctccttcct

SEQ ID NO: 80811 - DNA, 201 bp, Homo sapiens
tgtctcctgggggaggaatataccctcttatctttatttctcaggccctggttatccaacttctgccccagaacttcccctccccactgctatcttaaaaraaagaaaaaaaagttaaccagtcttcagttctcctgaggaagcatttgaaaagtctggtagggactacaggaaagcctggcacttaggaaaaccacaaga

SEQ ID NO: 80812 - DNA, 201 bp, Homo sapiens
gaaagagacaattgggatgcaaggtggctcatgcttgtaatcccagcactttgaaaggccaaggcgggtggatggtttgagctcaggagttcacgaccagygtgagcgacatggtgaaatctcaaaaatacaaaaattagccgggcatggtggcgtcgcctgtggtccctgctacttgggaggctgaggtggaggatagct

SEQ ID NO: 80813 - DNA, 201 bp, Homo sapiens
ccctggcagcggcccgcggggttgccctggcctggacgcgtcctgtggcttgggtgggaggagaggggagggccctgccccgttttcttcctaccggcccwccgtgcccacctcgcaggcgaggtcagagcttccatgtgcttaacgggaaacaggaaggagcggcccggagcgcctgccccggcccggtagggctaaggc

SEQ ID NO: 80814 - DNA, 201 bp, Homo sapiens
cggcccaccgtgcccacctcgcaggcgaggtcagagcttccatgtgcttaacgggaaacaggaaggagcggcccggagcgcctgccccggcccggtagggytaaggcataccgttatgaggtgtggatggctggcaagggagctcctggtggaactggctttctgggccgtagcttgttaatcactagaggcccgtggcaa

SEQ ID NO: 80815 - DNA, 201 bp, Homo sapiens
caacaaggaagactattcaggacttcttcagtggaagcagggagccggtgggacctttgtcactcctcccttgtcaacaactcctttctattttcctcagktattcttccaaactatgagagccagtcagactgaccacctggagtctgagagaattccttcctctcaggccgaaacttctgccttctcagccgtttggat

SEQ ID NO: 80816 - DNA, 201 bp, Homo sapiens
gctggctgatccctcactgtgtccttcaacaccgccccagctgtctctcaaacccaccggcgtctccctgcccctggggccatagtctcatgcagtgtttkggtccgtggaggcctttggtgggactttgcagacaagctgtaggccagatgaggctgaggactactgttctgactgcctctcacccacctcttttttaca

SEQ ID NO: 80817 - DNA, 201 bp, Homo sapiens
agccacacacgtctgaccgttccctccctcctctgggtatccaagtggtcactcccaccatgttgttcgtctttcagttgggggaggaggtttacatagcrgctctttcctagactgagagggtatgggtgttcccctgcagactaggattctgttttctggatgagcatttatacgaaatagctctgaccaggcaccgtg

SEQ ID NO: 80818 - DNA, 201 bp, Homo sapiens
ggtccgtggaggcctttggtgggactttgcagacaagctgtaggccagatgaggctgaggactactgttctgactgcctctcacccacctcttttttacartctggcttattttgaggcccatcctgcagcctggagggataacacacctctcattggctccatccatggcttgtagacttctagttcatgacctgcttct

SEQ ID NO: 80819 - DNA, 201 bp, Homo sapiens
gacctcgtgatctgccagcctcggcctcccaaagtgctgggaccacaggcatgagccatcacggccggcctaacagtaaatgttaaaactggaaagccacygtattacagatgaggaaactgatttgcccaaggctacatagccaggatagggatctagagttcgactctctgcccccttctccttttgatacatcctgaa

SEQ ID NO: 80820 - DNA, 201 bp, Homo sapiens
acctcttttttacaatctggcttattttgaggcccatcctgcagcctggagggataacacacctctcattggctccatccatggcttgtagacttctagtwcatgacctgcttctgttgcctgaaagttttcaacaaggaagactattcaggacttcttcagtggaagcagggagccggtgggacctttgtcactcctccc

SEQ ID NO: 80821 - DNA, 201 bp, Homo sapiens
tctggggcctccctgctggggagatgggggtagtgcctctctgctaatggaggtgcaggaccaccagggagggctgtggtcatgggaagcctgcaacctcrgtgtaaaagcccccattaatctgcatttcccaagtcttccactctccctgcttggagtggaagaggacaggcgctatctcatcttggggatgaggaagtt

SEQ ID NO: 80822 - DNA, 201 bp, Homo sapiens
cccagttgcctttaaaccaaattctaaccagcctatccccaggtagggggacgttggttatattctgttagagggggacggtcgtattttcctccctaccygccaagtcatcctttctactgcttttgaggccctccctcagctctctgtgggtaggggttacaattcacattccttattctgagaatttggccccagctg

SEQ ID NO: 80823 - DNA, 201 bp, Homo sapiens
agagggggccatgtgcacacatcaaagtgttccgcattgtcccttctctgtgcattttctacccttgtcccttctttattcaattttctacaacttttctstaggaaaaaagtgtgtgtttgtgtggggaaagttccactgtggataattacatttaattttgttcagttcagaaggcttccatctgtttaattaaatatt

SEQ ID NO: 80824 - DNA, 201 bp, Homo sapiens
tttgtatttttagtagagatgaggtttcgccatgttggccaggctggtctcgaactcctgacctcgtgatctgccagcctcggcctcccaaagtgctgggmccacaggcatgagccatcacggccggcctaacagtaaatgttaaaactggaaagccaccgtattacagatgaggaaactgatttgcccaaggctacatag

SEQ ID NO: 80825 - DNA, 201 bp, Homo sapiens
gaattcagttattaatggtatcttgtgagggtatctgcaggtatttgggggctgctgggggactgtgctatcctctgacctagccatttctgcttcctctrccagctggagattcacattttacctgattgccttcattgccggcatggccgtcattgtggatgtgagtggggattactgggaggtgggagtaggttctct

SEQ ID NO: 80826 - DNA, 201 bp, Homo sapiens
tacaacttcctgaactcccatcttgccagtaactctctaaaaaactagtgtggagccctgggtataacaggaacaagccctcagagagaagcagtacttakgggtttgaggatctcatgtaataacccttcttgtcccttttccacagctggtagaagatgaacgcagtgaccgggaagaaacagagagctcagaggggga

SEQ ID NO: 80827 - DNA, 201 bp, Homo sapiens
cttacctctctctcctctcccagagcactatcccttcccagtattggtactacatgattgaactttccttctactggtccctgctcttcagcattgcctcygatgtcaagcgaaaggtgggtgaaggggttgtgcaattaagcctcagagccaaaatgaggccctgggatgaacaccctctcctttgacttctgggtactc

SEQ ID NO: 80828 - DNA, 201 bp, Homo sapiens
aaaagcctccattctggtctctcatttctgtttttttttttgttttgtttttgagacagagtttcgcttttgtcacccaggctggagtgcagtggcatgayctcggctcactgcaatctctgcctcaagggttcaagtgattctcctgcctcagcctcccaagtagctgggattacaggcatccaccaccacacctggcta

SEQ ID NO: 80829 - DNA, 201 bp, Homo sapiens
tgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaat

SEQ ID NO: 80830 - DNA, 201 bp, Homo sapiens
gccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaata

SEQ ID NO: 80831 - DNA, 201 bp, Homo sapiens
atttggggttttggttttaaagccagaattacggctagcacctagcatttcagcagagggaccattttagaccaaaatgtactgttaatgggttttttttwaaaattaaaagattaaataaaaaatattaaataaaacatggcaataagtgtcagactattaggaattgagaagggggatcaactaaataaacgaagagag

SEQ ID NO: 80832 - DNA, 201 bp, Homo sapiens
gaggcggaggctgcagtgagtcgagattgcaccattgcactccagcctgggtgacagagcgagaactccatctaaaaaaattcacatgcaagaagcaaagrtagacaaggtagaagatgaatgacagcagcccacaggggaggatggggataatacctcactgaaagatccagaattgggagtatcgggctgagagagaga

SEQ ID NO: 80833 - DNA, 201 bp, Homo sapiens
gtaaatgggaagggctcctttaagtccttgctgttacccacggtttggcaggaaagggcggtggcaagaggaagattagatgctggatgaaagaaaataargcaggaagtcaaggctaaagaagtaggagaagacctaacagtaattatagtgaaggacttgatgaggtgacaatggcccattttcctttattagactctg

SEQ ID NO: 80834 - DNA, 201 bp, Homo sapiens
gctaatttttgtattttttagtagagacggggtttcaccatgttggccaggatggtctccaactcctgaacttcaagttatccacctgcctcggcctcccaaagtgttgggattacaggtgtgagccactgtgcccggtcaataatttggttctttaaacaaacactaggaatgtgctagttagggggagagataacgagg

SEQ ID NO: 80835 - DNA, 201 bp, Homo sapiens
caatttgtctctggttcaattccctaccatgtcccagtctcaggaaacaacccttatattttatcaccaacctgcataaatacaaacaaaagagcctttgscaatgtcatccaagcagcggataccccagcccttgttctgtgtcttgaatagctgtagccgaacttgtagtccatgttgcaccaaccggtttgtgcacat

SEQ ID NO: 80836 - DNA, 201 bp, Homo sapiens
aatttgtctctggttcaattccctaccatgtcccagtctcaggaaacaacccttatattttatcaccaacctgcataaatacaaacaaaagagcctttggsaatgtcatccaagcagcggataccccagcccttgttctgtgtcttgaatagctgtagccgaacttgtagtccatgttgcaccaaccggtttgtgcacatg

SEQ ID NO: 80837 - DNA, 201 bp, Homo sapiens
gagtctttcttatgccttccttgcagttatgtaatattttcttttttaaatttcacatgcatgtaatttgagcactttgaggggccaaggagggtggatcmctagaggtcaggagtttgagaccagcctggccaacatggcgaaaccccatctctactaaaaatacatctagctgggtgtggtggcgggcgactgtaatct

SEQ ID NO: 80838 - DNA, 201 bp, Homo sapiens
tggtttggagtagaatggcaactaattctaatttttatttattaaatatttggggttttggttttaaagccagaattacggctagcacctagcatttcagyagagggaccattttagaccaaaatgtactgttaatgggtttttttttaaaattaaaagattaaataaaaaatattaaataaaacatggcaataagtgtca

SEQ ID NO: 80839 - DNA, 201 bp, Homo sapiens
gtgcagtggtgcgatctcggctcactgcacctccaccctccaggttcaagcgattctcctgcctcagcctcccaagtagctggaaatacaggcatgcaccwccacgcccggctaatttttgtattttttagtagagacggggtttcaccatgttggccaggatggtctccaactcctgaacttcaagttatccacctgcct

SEQ ID NO: 80840 - DNA, 201 bp, Homo sapiens
tgtatttttggtagagatggcgtttcaccatgttggccaggttggtctcgaactcctgacctcaggtgatctgcccgcctcagcctcccacagtgttgggwttacaggtgttagccaccgcacccggccacggggacctattagaaagaataaggattattccatcaatacccgctctaccagcatatagagtcaaaaagc

SEQ ID NO: 80841 - DNA, 201 bp, Homo sapiens
aattcagttattaatggtatcttgtgagggtatctgcaggtatttgggggctgctgggggactgtgctatcctctgacctagccatttctgcttcctctgmcagctggagattcacattttacctgattgccttcattgccggcatggccgtcattgtggatgtgagtggggattactgggaggtgggagtaggttctctg

SEQ ID NO: 80842 - DNA, 201 bp, Homo sapiens
gccaatggccaccccatcctcaataacaaccatcgtaagaatgactgaaccattattccagctgcctcccagattaatgcataaagccaaggaactacccygctccctgcgctatagggtcactttaagctctggggaaaaaggagaaagtgagaggagagttctctgcatcctccctccttgcttgtcacccagttgcct

SEQ ID NO: 80843 - DNA, 201 bp, Homo sapiens
caccacattggaagggatcatctggtccagaacccccatttctatcaactaggagctggggggagtagctagcccagagacttcgggtcagggttcaacartcaggaagacccagttcctgaggaaacgacagttcaagaagggttgggaagaaggctgtcctctaaagaagacgtcctctgcattcaatggccccacagc

SEQ ID NO: 80844 - DNA, 201 bp, Homo sapiens
gtgtcgttgttgtggcctggtagcttgcctgtgtgagcactgcctccggtgtggcctggtagaggaaagtgggggtgtgtgcagcctaggctgaacagccmgtcagatgacctctcttagggacgaacccagcagttgtctgactctggcccctcccagacgtgggagaggaccgggctgtacagagtcccacatgcagac

SEQ ID NO: 80845 - DNA, 201 bp, Homo sapiens
gctgctgggggactgtgctatcctctgacctagccatttctgcttcctctgccagctggagattcacattttacctgattgccttcattgccggcatggcygtcattgtggatgtgagtggggattactgggaggtgggagtaggttctctggcaaggtcaggtgaggccatggaatttgggttcctcctcttttaacttc

SEQ ID NO: 80846 - DNA, 201 bp, Homo sapiens
aagcctcagagccaaaatgaggccctgggatgaacaccctctcctttgacttctgggtactctgaatggagctgttggtatatggggaaccaaaggcaagkggtaagaaggcatagtgagagctggggaataaaaaaaggccctggggcctgcatcatctctgcaggatttcaaggaacagatcatccaccatgtggccac

SEQ ID NO: 80847 - DNA, 201 bp, Homo sapiens
ggtggctatacgcagggagatgtgaggaggtgaattcagttattaatggtatcttgtgagggtatctgcaggtatttgggggctgctgggggactgtgctrtcctctgacctagccatttctgcttcctctgccagctggagattcacattttacctgattgccttcattgccggcatggccgtcattgtggatgtgagtg

SEQ ID NO: 80848 - DNA, 201 bp, Homo sapiens
gcggtagatgcctcccttctgaggtctatggccctccttcctgggcctggctggggtctcctgggcagtgcaggggagctgaggtgaggtggcaggattawccacgcagagtggaagacaactcgaaatagcatcttcccccaccggcagccccagctgacaagcaaccctcaattcctgcctgtacagctgcctacctgc

SEQ ID NO: 80849 - DNA, 201 bp, Homo sapiens
aggaggcactctcatgttggaaaaggaaaactcatttttccctcccccaagcaatcaacaagccctcctggcatggggccgtgggcccagtacttactcaraggtgccagaggtgaggtgggtgtcgttgttgtggcctggtagcttgcctgtgtgagcactgcctccggtgtggcctggtagaggaaagtgggggtgtgt

SEQ ID NO: 80850 - DNA, 201 bp, Homo sapiens
tctcatgttggaaaaggaaaactcatttttccctcccccaagcaatcaacaagccctcctggcatggggccgtgggcccagtacttactcagaggtgccaraggtgaggtgggtgtcgttgttgtggcctggtagcttgcctgtgtgagcactgcctccggtgtggcctggtagaggaaagtgggggtgtgtgcagcctag

SEQ ID NO: 80851 - DNA, 201 bp, Homo sapiens
tcagtgttaacagttccacctgacctgaaaaaacctaccttccacatttgggctccctgtatgcttgcccatccacaaagcctgcccagatatctaaactyggggctgaaggcctggagatggcctgtcctctccttgggacagttcagcagcccatacagaggaagtgagtcactgcaaggcaggcagcacttggggcac

SEQ ID NO: 80852 - DNA, 201 bp, Homo sapiens
tccgcctcccgagtagctgggattataggcgcctgccatcatgcctggctaattttttgtattcttagtagagatagggtttcaccatgttggccaggctrgtctcgaactcctgacctcgtgatccacctgccttggactcccaaagtgctgggattacaggcgtgagccaccgcctgtaattattattttttgtttatc

SEQ ID NO: 80853 - DNA, 201 bp, Homo sapiens
tctgaccctccccattataatagatgctttgaaagaaagctacctctttaagatcctttgagatcaagagtttataacaagaaaagggcttatagagtatsttaaaagaaatctgaggaccatgggataatccagcatctagaggtggggagaggggtctcacgttgaggtagcggcccaggttgccttcaagcttggcat

SEQ ID NO: 80854 - DNA, 201 bp, Homo sapiens
tgctcctaactggagtgtacatatgaatgtactcgagggagtcaggagcccatgatgatggatgggggctctctatgcagtcagccaagatgtttaactaygcgggatggaagaacacctgcaacaacatcttcatcgtcttcgccattgtttttatcatcacccgactggtcatcctgcccttctggtgagtaggcagct

SEQ ID NO: 80855 - DNA, 201 bp, Homo sapiens
caagcttggcatcaatgatgtagcaagactcctcgccatcatagaattggcgtgtgttcttacgaacaggtgcgctctcccccttgtccacagaggccatrttggttgatttaattgcaatcccatgggttgatttaagagcaaagcctcgggttgattttactgccacttgacgcttcattggacctggacaggagggag

SEQ ID NO: 80856 - DNA, 201 bp, Homo sapiens
agattaaataaaaaatattaaataaaacatggcaataagtgtcagactattaggaattgagaagggggatcaactaaataaacgaagagagtctttcttaygccttccttgcagttatgtaatattttcttttttaaatttcacatgcatgtaatttgagcactttgaggggccaaggagggtggatcactagaggtcagg

SEQ ID NO: 80857 - DNA, 201 bp, Homo sapiens
gatcaactaaataaacgaagagagtctttcttatgccttccttgcagttatgtaatattttcttttttaaatttcacatgcatgtaatttgagcactttgrggggccaaggagggtggatcactagaggtcaggagtttgagaccagcctggccaacatggcgaaaccccatctctactaaaaatacatctagctgggtgt

SEQ ID NO: 80858 - DNA, 201 bp, Homo sapiens
agtcccaagtaagttctgtcccagcccggattcttctgaagaggaagaaaaggatggtgtgtggcaaagacagcagataacccaggcacttggggttactsaatatgtaggtggagttggatcatgaatggaggaggggcccttagaacttcagtggtccttgcccctccccagtcatcccctttcctgactccttacttg

SEQ ID NO: 80859 - DNA, 201 bp, Homo sapiens
cccaactcatgaacagacattctatcatgaatggacattctacccctatttctctcccaacattgcagctgagaaacaccaataagctggaactcaaagaycctaagtagcaggtttttttttcaagcataattagatctgctagacaaaggagctgaggggaaagagtaaaaaaatggaaatgagagaggatgtgtcaaa

SEQ ID NO: 80860 - DNA, 201 bp, Homo sapiens
cctatccccaggtagggggacgttggttatattctgttagagggggacggtcgtattttcctccctacccgccaagtcatcctttctactgcttttgaggscctccctcagctctctgtgggtaggggttacaattcacattccttattctgagaatttggccccagctgtttgcctttgactccctgacctccagagcca

SEQ ID NO: 80861 - DNA, 201 bp, Homo sapiens
gggcccagtacttactcagaggtgccagaggtgaggtgggtgtcgttgttgtggcctggtagcttgcctgtgtgagcactgcctccggtgtggcctggtaraggaaagtgggggtgtgtgcagcctaggctgaacagccagtcagatgacctctcttagggacgaacccagcagttgtctgactctggcccctcccagacg

SEQ ID NO: 80862 - DNA, 201 bp, Homo sapiens
ggtgtcgttgttgtggcctggtagcttgcctgtgtgagcactgcctccggtgtggcctggtagaggaaagtgggggtgtgtgcagcctaggctgaacagcmagtcagatgacctctcttagggacgaacccagcagttgtctgactctggcccctcccagacgtgggagaggaccgggctgtacagagtcccacatgcaga

SEQ ID NO: 80863 - DNA, 201 bp, Homo sapiens
agaggaaagtgggggtgtgtgcagcctaggctgaacagccagtcagatgacctctcttagggacgaacccagcagttgtctgactctggcccctcccagaygtgggagaggaccgggctgtacagagtcccacatgcagacaccttcctgcccagcatctcttctcccaggaactgggcctcaatccatgtgagtgaactc

SEQ ID NO: 80864 - DNA, 201 bp, Homo sapiens
ttcaacttcagggccggattgcagttgtttacagttgtactgatcaccttccttccccatgttgtacattttagaattgcagagttggaggaaatcttagrgaggatctaatctaccaccttttcttttcttttttttgagacagagtctcactctgttgcccaggttagagtgcaatggcgcgatctcggctcattgcaa

SEQ ID NO: 80865 - DNA, 201 bp, Homo sapiens
gtgctggaattataggcatgaatcactgcacccagccttttatttatttttgagatggagtctcactctgttgccaggctggagggcagtggcatgatctyggctcactgcaacctcaccctcctaggttcaagcaattctcctgcctcagcctccaaagtagctggaactacaggcatgtgccaccatgcctagctaact

SEQ ID NO: 80866 - DNA, 201 bp, Homo sapiens
taattccagggaatcacgtctgcaggttgctgtagacaataaatgctttttttttttttttgagacagtctcgctgtcacctaggctagagtgcaatggcrtgattccggctcactgcaacctctgcctcctgggttcaagcgattctcctgcctcagcctcctgagtagctgggactataggcgcccgccaccacaccca

SEQ ID NO: 80867 - DNA, 201 bp, Homo sapiens
agaccagctttctaggaaaaccatgttgcatcttccaacagtaattacttctgaaacagtaattttaccacacgactcaaggggaaaactttttttttttwaatttataaaggagttgggggtctcgctatgttgaccaggctggtcttgaactctgacctcaagtgatctgcccacctcggccacccaaagtgctgagat

SEQ ID NO: 80868 - DNA, 201 bp, Homo sapiens
atccgcccacctcggcctcccaaagtgctggaattataggcatgaatcactgcacccagccttttatttatttttgagatggagtctcactctgttgccargctggagggcagtggcatgatctcggctcactgcaacctcaccctcctaggttcaagcaattctcctgcctcagcctccaaagtagctggaactacaggc

SEQ ID NO: 80869 - DNA, 201 bp, Homo sapiens
ctggtcttgaactctgacctcaagtgatctgcccacctcggccacccaaagtgctgagattacaggcataagccacggcgccaggccaaggggagaacactttttttttttttttcctgagacggagtctcactctgtcgcccaggctggagtgcagtggcgagatctcggctcactgcaaactccacctccagggttcaa

SEQ ID NO: 80870 - DNA, 201 bp, Homo sapiens
cgagtcttactctgtcacccaggctggagtgcagtggtgtgatctcagctcactgtaacctctgcctcccaggttcaagtgattctccttcctcagcctcycgagtagctgggattacagggcccaccaccacacccagctaatttttgtatttttagtagagacagggtttcaccatgttggccaggctggtcccaaact

SEQ ID NO: 80871 - DNA, 201 bp, Homo sapiens
cacgcccagcctcccggcccttgggctgctcgcggcctttttttcccggctgggctcgggctcagctcgactgggctcggcgggcggcggcggcggcgccsgcggctggcggaggagggagggcgagggcgggcgcgggccggcgggcgggcggaagagggaggagaggcgcggggagccaggcctcggggcctcggagca

SEQ ID NO: 80872 - DNA, 201 bp, Homo sapiens
aaactgatttgcccaaggctacatagccaggatagggatctagagttcgactctctgcccccttctccttttgatacatcctgaaaacttttattcatctmtctcttcctccatagctactccctcttgatgccctcccctttgcccctcactcaggatgctccagaccttgtatgattacttctggtgggaacgtctgtg

SEQ ID NO: 80873 - DNA, 201 bp, Homo sapiens
gacaggcgctatctcatcttggggatgaggaagttgcactgcccaggtgtctgtccttgaccatgctctagtgcctactttgcctgccccccaccccctgytttgcaggcatgagacattcctgggccccaggagtccagcaggggctccaccctccctctgcgactccagcctgccgcctgactagagaaacatccctgc

SEQ ID NO: 80874 - DNA, 201 bp, Homo sapiens
gcctggtttcttagattgcttctgttgccttttggcagcctgggccctgtggctgttttagctgcaggtgatgcaaccccagcagctggacttgaggctgyctctgcacagagcagcaggtgaacagccctgtggagcccccgccccgccatgcagcaactgctccagcctcacagctggctccctcaggtctaaacacag

SEQ ID NO: 80875 - DNA, 201 bp, Homo sapiens
cgcccgagtgatcgcaggctccgactgggtctcgagggtcggctgcttcggtctgccctggagaggttttcagcttcggcgcgaggcacttgggcaggatmcccgggctgcaccctcctccgcccgcgccccgtggggctggaagtgggaatgtgcccaccctggcggggaccgggggccgcacagcagttgggggtgggt

SEQ ID NO: 80876 - DNA, 201 bp, Homo sapiens
gtcaggctgatttctcgcttccaatcaggctgagcaaaaaagtgggaagagggggccatgtgcacacatcaaagtgttccgcattgtcccttctctgtgcrttttctacccttgtcccttctttattcaattttctacaacttttctctaggaaaaaagtgtgtgtttgtgtggggaaagttccactgtggataattacat

SEQ ID NO: 80877 - DNA, 201 bp, Homo sapiens
ctagctgggtgtggtggcgggcgactgtaatctcagctacttaggaggctgaggcaggagaatcacctgaacccgggaggcggaggctgcagtgagtcgarattgcaccattgcactccagcctgggtgacagagcgagaactccatctaaaaaaattcacatgcaagaagcaaaggtagacaaggtagaagatgaatgac

SEQ ID NO: 80878 - DNA, 201 bp, Homo sapiens
tctctaaatgggaggattgagagagacggaggctgtgggacatgctggggcctccgaggacaggtttcctgggatgattaaatgaagtaatgtgtccactraagaacttatccatgtaaccaaacaccaccttgtccccaaaaactattgaactcataaaaataaataaataaataaataaataaataaggtaatgtggcc

SEQ ID NO: 80879 - DNA, 201 bp, Homo sapiens
agtgccctgtaaagtaggggtattagattaaataaataaatatacaggacatgcagcttaatcagaatttcacgtaaatgaggaatcatttgttggtacamgtatgacccaaatatttcattaaatatactaacatttttttttttgaggcggagtctctctctgttgcccaggctggagtgcagtggcattatgttggct

SEQ ID NO: 80880 - DNA, 201 bp, Homo sapiens
aaaaacctgttggggcacataccagcagggcaccccagcctgcaccccagagggggtcccagcccagaaactcccttgactgctgccttactagagccagmtgacctaggtggagagtgcccagggattgtgtatatctgtggagaaggaagggcacaagtatttgggagtggaagttgatgaacagagtcaagagagaaa

SEQ ID NO: 80881 - DNA, 201 bp, Homo sapiens
ccccgaggctgacctcagacacatgcaggagactgggtgaccgcagttaggctgggtaaacacggtactgcagctccgcagccggggtccccctggccctyggctttctgtacccttcagagtttcttctggctacctgcccagcagatttagggagaaccgaaggaagcgtgaggcctcctgtttcctcacgccgaatct

SEQ ID NO: 80882 - DNA, 201 bp, Homo sapiens
tgtttacagttgtactgatcaccttccttccccatgttgtacattttagaattgcagagttggaggaaatcttagagaggatctaatctaccaccttttcktttcttttttttgagacagagtctcactctgttgcccaggttagagtgcaatggcgcgatctcggctcattgcaacctccgactccctggttcaagcaat

SEQ ID NO: 80883 - DNA, 201 bp, Homo sapiens
ttttctttgggagggaggtgcggggtgggaatttggaggatgacattcctgggaccaaggaggagggcacagagtcagtgctcctaactggagtgtacatmtgaatgtactcgagggagtcaggagcccatgatgatggatgggggctctctatgcagtcagccaagatgtttaactacgcgggatggaagaacacctgca

SEQ ID NO: 80884 - DNA, 201 bp, Homo sapiens
atggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccag

SEQ ID NO: 80885 - DNA, 201 bp, Homo sapiens
tggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccagg

SEQ ID NO: 80886 - DNA, 201 bp, Homo sapiens
ggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccaggc

SEQ ID NO: 80887 - DNA, 201 bp, Homo sapiens
ttggctacagcttctagggccaggtcctgcctgtcttgcaggttaagatagcaaaatgacaagacccccaaggttcttcccccactccccgaaatcagagkttgtaaggaccccaagtttcttaattccagggaatcacgtctgcaggttgctgtagacaataaatgctttttttttttttttgagacagtctcgctgtca

SEQ ID NO: 80888 - DNA, 201 bp, Homo sapiens
atggacgtgtctacgccaaagcctcagatctctatatcacgctgcccctggccttgctcttcctcatcgttcgatacttctttgagctgtaagcatgccarcctaccctcatgccttcccctgttgccagttgcagtttcttggacttcaagtttgttccttgctgtttaattagcccttgaccctgatgttctggctact

SEQ ID NO: 80889 - DNA, 201 bp, Homo sapiens
ggggtgctcgccccgcgggtccctttcattcctaggaaaacgcgccgcggggcctcccgtctgtctgtcttgcacacacgtgttgccaaatccccccgcascgtctttagatctggactggccgccccaccttctcccttcattgatctatgttttgctttttcttttcctaccttgtttccattgacaaagtagaccctt

SEQ ID NO: 80890 - DNA, 201 bp, Homo sapiens
gttttattaaaagacagtcaagtccacttgtgtacatattattcataacagcagcgttgagtaggcctgcaaagcctaaaatatttactatctggaccttyatagagtttactgactcctgatatagaaagaaaggtacaccagccatataaataaccacaattaacaatgtggtatgtttctgtgttggggaaatcaaga

SEQ ID NO: 80891 - DNA, 201 bp, Homo sapiens
tcagtgaacattgggtgcaattattgttattggtacacgtgtgttccttcattctcagttaaactttatcgtacagctcgcggtgaagggtcatgtaaggmatggtctgtaagaaggaacatggctaacttgctggtcaggacttctaggggtgccactgtgagcctttgacaactgcctttgttaattatcatcaaggac

SEQ ID NO: 80892 - DNA, 201 bp, Homo sapiens
ttgccaaacagaaaaattttcacctcgtcagatttctgcgttaatggaaccatttgggaaactcaattatttgccaccaaatgcctctgctttatttagamagctggaaaacgtgctattcactcatttcaattattttccacccaaatcattattgaaacttcttcattcatgttcacttaatgaatgccatccagtcaa

SEQ ID NO: 80893 - DNA, 201 bp, Homo sapiens
actcccatataaaaaaatatatataatatatatctttacatagatatatatatacatcctattagttctgtcccttgagggaaccctcactaatacactaygtttaacccagccccagtgtgtgtccttactctattaatttgcctcctttgagaggagggtttttatgcttctttcatcctccccttctccggcacagaa

SEQ ID NO: 80894 - DNA, 201 bp, Homo sapiens
actgcagtagagaactgattctttcaaaacccatcctcaatgcagtggcagaaacttttgtttgccaaacagaaaaattttcacctcgtcagatttctgcsttaatggaaccatttgggaaactcaattatttgccaccaaatgcctctgctttatttagaaagctggaaaacgtgctattcactcatttcaattattttc

SEQ ID NO: 80895 - DNA, 201 bp, Homo sapiens
aatagaatacttctgtctggagtgtgtaaattgatgttgaatgttcatgatgttctctcatacatacctcaattcagacgtaactatgactgggatgcttwctgtttcaggtaaagaatctcatttggacacattgagtcgggcacaactgacccaacttttcttagcctcagtcctggaatgccctttctataaggtaaa

SEQ ID NO: 80896 - DNA, 201 bp, Homo sapiens
tatttttaagccaagccagaaatttcacttttatctaatagagtttagtttatctagagttcgctcttcccataaagacctataaagatttatcctattayctatcacattccttatgtagaatcagaaatagcacaccagactatgacattctctctctgcttctctctacttgactctgaatcatagtttagagtatct

SEQ ID NO: 80897 - DNA, 201 bp, Homo sapiens
tttccaacctgagtcctaaattgattagccaaatgctcactgccctggtggttcttgatcaaagtcaagcatttcctctgattataaaattgggcaaataygtcgtgaggcatgtcccacatttcactaacgaggagcttaggagagtcttggaggcgttcatatattttgggcaccatgacacattttttacaaaagccc

SEQ ID NO: 80898 - DNA, 201 bp, Homo sapiens
atactagagcctttttggtttttttcatatataaactagattcccaaaaatgtgattagtggattaatttttgatggatactggcagattttttttccctwatagttacagatgtcacatttccccagcaatgaatgaaggtggccatgtctcctccacttctattgcagtgtgttagtagtctctttaatttgtgttact

SEQ ID NO: 80899 - DNA, 201 bp, Homo sapiens
tatagatatgtgaagattgggctgactaaccttttaggagcaagattatattttgctccaaaagtgttgacaccctattgttatacaataggtaagtagtrtaaggagttttgttgttttaaacctaagcatcctgttcgattttggagatatatgggacttagaagcaatagaagttctctggaaatgcaaaatggaatg

SEQ ID NO: 80900 - DNA, 201 bp, Homo sapiens
ggtttaagtctcaaatattagccacgtagtagcagaatatcctgggcagaatatttaacctttttctgcttgcttcttcctctgtaaaatgatagtaataytgacctcaaagacttacttaaggtctaaataaaatagtacctggaacgtaggaaatgctcactaattgttagctactactataacctaggcttgtactgt

SEQ ID NO: 80901 - DNA, 201 bp, Homo sapiens
aaaacaaagactatgtggtggtattagtgtccttttgtttcataaatatcacttcccaaccaaaattcttcaaagcacaaaacggtaaaatccactgtaayggctctaaccttatcggattcactaatacagtgaagatctgcagaaaatccatgtaccacagcttgctcacatatttcttctgcgatggcctttgcctgt

SEQ ID NO: 80902 - DNA, 201 bp, Homo sapiens
gtaagtgctcagtagccacatgtggctcatggctgccaaattggacagcaccattataaagatttccacatcacagaaatttctcctggacagcactgacragagactccaagtcctccgtccttacagttcttctaacttgatgagcagaagaaagccttctcgtaaaggacagcagttcataggcttcagatggtcact

SEQ ID NO: 80903 - DNA, 201 bp, Homo sapiens
tatgctacttctgtcatttacagttgagttgttacttgtttcaatttttgagaccatttagtctaattcaactacacacttctatattaaaaaaatgctgstgatatcttactataccattgaacaaacacatttctgttaaaaaacaaagactatgtggtggtattagtgtccttttgtttcataaatatcacttcccaa

SEQ ID NO: 80904 - DNA, 201 bp, Homo sapiens
gatttgtattgccatccacagctaatgaagatatccataaaaggtacaggaaaatgttgtgtttttcacattacaagactcgttgaggctaataagcagcrgtatctttttctcaagaaggtgaaaaaaatagatatgattctggaaattaaaatactacatttcagaataccatgttgggaaattccttgtaatatttta

SEQ ID NO: 80905 - DNA, 201 bp, Homo sapiens
acaagatggtaaagttgcatataccctaaggtaggaacttctgcagagactgaacataaacaactagtccctgaagaagcagccgagttttttccagatcyttacactactactttaaattctatttcacaaaagaatctaggcggtccttcatcaggaggaactctaacacgcacggcaaggcctttcttttggggaaaa

SEQ ID NO: 80906 - DNA, 201 bp, Homo sapiens
agctaatgaagatatccataaaaggtacaggaaaatgttgtgtttttcacattacaagactcgttgaggctaataagcagcagtatctttttctcaagaargtgaaaaaaatagatatgattctggaaattaaaatactacatttcagaataccatgttgggaaattccttgtaatattttataaacattaatattaataa

SEQ ID NO: 80907 - DNA, 201 bp, Homo sapiens
gaaatgttgaagtgaattttaactgcttagcggctggcaaatcatcttgtggtataaagcccctgccaactgttatcgcctgaattgtctgaaatagtatratctggaggcagcaaactaaataaaagaacacaagatggtaaagttgcatataccctaaggtaggaacttctgcagagactgaacataaacaactagtcc

SEQ ID NO: 80908 - DNA, 201 bp, Homo sapiens
ataccatgttgggaaattccttgtaatattttataaacattaatattaataagatcaaattcatgattcatttgaaaataatattggcacatagtaatagmcaaatcccaaataaactttggcaactaaaatatataataaatattttggattatttaaaaaattaagtatttttctccttttttatttttcaggatagca

SEQ ID NO: 80909 - DNA, 201 bp, Homo sapiens
gtgcacttgggtgagagagcactggcaggacagtctctgaaatgttgaagtgaattttaactgcttagcggctggcaaatcatcttgtggtataaagcccytgccaactgttatcgcctgaattgtctgaaatagtataatctggaggcagcaaactaaataaaagaacacaagatggtaaagttgcatataccctaaggt

SEQ ID NO: 80910 - DNA, 201 bp, Homo sapiens
gacccggagggagatagcttgaatcatgggggtggttcccccatattctcgtggtagggaataagtctcatgagatctgatagttttatcaggggtttccrcttttgcatcttcctcattttctcttgccgccaccatgtaaggagtgcctttcatctcctgccatgattctgaggcctccctagccatgtggaactctaa

SEQ ID NO: 80911 - DNA, 201 bp, Homo sapiens
gtacatgtggacacttgaaagatatttgatagaattctgggaaaacggaagcagtcagttcctcctaaaaaaaaaataaataaaattaaaaaaaaaaaaaagtatacctaccagaagatgatgtgcgcaaatccagagaggggtcttggctcagtgaggaaccaggcaaattatccccttagggctgcgatctcccaaatt

SEQ ID NO: 80912 - DNA, 201 bp, Homo sapiens
agcttacccacgccgcgccagccgggcacgaacctgcacaacgcgacttccaccaaccttgcgccagcgcgcactgacgcagcgcccatgctcggtacccrggaccaatagaaagctccgaaggggacctgggccaatcacattgcgccgccctgagtcgtgctcccgccccgcgtttgctacggaggcccacgacgccca

SEQ ID NO: 80913 - DNA, 201 bp, Homo sapiens
tatgtgaggaatgtgcgtcgcttgggtacatgtggacacttgaaagatatttgatagaattctgggaaaacggaagcagtcagttcctcctaaaaaaaaaataaataaaattaaaaaaaaaaaaaagtatacctaccagaagatgatgtgcgcaaatccagagaggggtcttggctcagtgaggaaccaggcaaattatcc

SEQ ID NO: 80914 - DNA, 201 bp, Homo sapiens
tctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttcaa

SEQ ID NO: 80915 - DNA, 201 bp, Homo sapiens
ttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttca

SEQ ID NO: 80916 - DNA, 201 bp, Homo sapiens
cttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttc

SEQ ID NO: 80917 - DNA, 201 bp, Homo sapiens
tcttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagttt

SEQ ID NO: 80918 - DNA, 201 bp, Homo sapiens
ttctaacaagttcatttcatagtgtcatttaaaaatagaatacttctgtctggagtgtgtaaattgatgttgaatgttcatgatgttctctcatacatacmtcaattcagacgtaactatgactgggatgctttctgtttcaggtaaagaatctcatttggacacattgagtcgggcacaactgacccaacttttcttagc

SEQ ID NO: 80919 - DNA, 201 bp, Homo sapiens
tctcatgtgttgtgggagagacccggagggagatagcttgaatcatgggggtggttcccccatattctcgtggtagggaataagtctcatgagatctgatrgttttatcaggggtttccacttttgcatcttcctcattttctcttgccgccaccatgtaaggagtgcctttcatctcctgccatgattctgaggcctccc

SEQ ID NO: 80920 - DNA, 201 bp, Homo sapiens
tgtaggactgatatggtttggctctacgtcccgacccaaatctccataattctcatgtgttgtgggagagacccggagggagatagcttgaatcatggggstggttcccccatattctcgtggtagggaataagtctcatgagatctgatagttttatcaggggtttccacttttgcatcttcctcattttctcttgccgc

SEQ ID NO: 80921 - DNA, 201 bp, Homo sapiens
tagacagtactaagttatataaagataaataatagttaaccccgatctcttaccatttctaaaggaacagtattaaaagcagtttctacgcccaaatgtawacagatacataaacactgtctattttttttctcttttcaaggaatgagactcactaatcaaagtacaatttgcttttatgcgcagtatatcatggccatc

SEQ ID NO: 80922 - DNA, 201 bp, Homo sapiens
aaaacacctgctgatcaacttactgaggtcaaccacaaggggccaaatcaggactagttttatgatactgatggctttggttttgtccaaagtaacagatycagatacttcatcatgtggcactgcaatctgaacttaagttactgtagaatgacagagtctgctgactggcagtctcctccaggaagctcccttttctct

SEQ ID NO: 80923 - DNA, 201 bp, Homo sapiens
cagagactttgcccctctggtgtttatatgttaaccatccttttttttttttttttttttccagatactcgtttgtagtttcataaacattgatgttgggycaatcatgttctcaatgtatttaaccatgtgtttttaaattttttaatttagttatcaaattgagaatctgatggtatggcattaatcaccttgaggaag

SEQ ID NO: 80924 - DNA, 201 bp, Homo sapiens
aaaaacttaaggtaaaaaaaaaattataaatactgtgaaatactctcttgaacatgttatatatgacagatcattgccagggttacaatctcaaatttctratcagttatttattatactcaacccatccttgctagataccctctccaaaaaataatcctcaaagataaaacaacataggtcacaagtcaggaatgcaga

SEQ ID NO: 80925 - DNA, 201 bp, Homo sapiens
gctgctttaaaaaataaacctctaaatcatgttcacaaggtagtcaaggagcgtctgtgcccttggttgtgttcacgacaacctgagcctttcggggtcarattccatcatgcccattgtaaaaagtttcattcgaaaaatggaaatgaccttcatccactcggtggaccagtgttctctcaagtatctgactgcgacagg

SEQ ID NO: 80926 - DNA, 201 bp, Homo sapiens
tgaactattctgtggaaagttcctagttatataattattagtttgtgagatgcttctgattggttgagcttaagttctgtttttctgtagtagaagcttckacaagaaatagcccaagttaaattttgcttaacatttgcactttaagcaaagttaaggttattttcaaggcccaactggcttggtctgctcagggatttt

SEQ ID NO: 80927 - DNA, 201 bp, Homo sapiens
gactttgcccctctggtgtttatatgttaaccatccttttttttttttttttttttccagatactcgtttgtagtttcataaacattgatgttgggtcaaycatgttctcaatgtatttaaccatgtgtttttaaattttttaatttagttatcaaattgagaatctgatggtatggcattaatcaccttgaggaagaacc

SEQ ID NO: 80928 - DNA, 201 bp, Homo sapiens
aatttctccttgatttaataaataaaaatgaacaagataatccattaaaataaggagcttcaccaacacttaatatttaagaccttttaaatatttcactrtagataatgtaagaaggtcttatgtgagggctcagcagtgcgtgagaatgagagctgccctaattctctaagctgtcagtactaggcagcactgtggttt

SEQ ID NO: 80929 - DNA, 201 bp, Homo sapiens
ggagcttcaccaacacttaatatttaagaccttttaaatatttcactgtagataatgtaagaaggtcttatgtgagggctcagcagtgcgtgagaatgagmgctgccctaattctctaagctgtcagtactaggcagcactgtggtttcatatctgctgacttttttctccatcttgcacatccccagctgaatattccta

SEQ ID NO: 80930 - DNA, 201 bp, Homo sapiens
atcaagacgtgaattggtggaatatttacaaagaaaactgttttctcaaaacactgttcattggttgcaagaatgaatactgacttcagaactcaaacaayggaagaacttgcatttttatggaactcagtattaaaagaaaaatataatgtgaattagccactttgcagaatatgttctagactggtgatctgaaagcat

SEQ ID NO: 80931 - DNA, 201 bp, Homo sapiens
gctaagatcattttttgtctccaattacaaagaaagagagaggcaatggaagcaaattgagattgagcaggagataagcacggtagattctgatgtatccrggtacccagctgaccttgccgctcatttgggacctggcttggaaggattctcacagctctctgaaatctgggtaattagatgatttacactttttcacag

SEQ ID NO: 80932 - DNA, 201 bp, Homo sapiens
tctgctttatttagaaagctggaaaacgtgctattcactcatttcaattattttccacccaaatcattattgaaacttcttcattcatgttcacttaatgratgccatccagtcaactttctggcaaaaatattcaagcctcttttccttcaacggctgcaaggtgagttggttataaattctgacagttggaaaaaagta

SEQ ID NO: 80933 - DNA, 201 bp, Homo sapiens
gagttttagaaggaagagagcagggtctaggggcgcaattgtcaatggctggaacacccagtgtaaagcatacagggttggcccagggagggaggctagasctgcctctggccctgttcaaattttaatcccgaagtacatgaaaataatttaggctaatagagagatataaggttgctggtgtcactaacgagcaaattt

SEQ ID NO: 80934 - DNA, 201 bp, Homo sapiens
ggaggctagacctgcctctggccctgttcaaattttaatcccgaagtacatgaaaataatttaggctaatagagagatataaggttgctggtgtcactaaygagcaaatttgacaagctttgtcaaatcataaagctaagtccttttaaactgaattctcatgctgatgaattcattggtatgtctatacctgtacaaaca

SEQ ID NO: 80935 - DNA, 201 bp, Homo sapiens
tcctggaaaatagtaaatactcagtgaacattgggtgcaattattgttattggtacacgtgtgttccttcattctcagttaaactttatcgtacagctcgyggtgaagggtcatgtaaggcatggtctgtaagaaggaacatggctaacttgctggtcaggacttctaggggtgccactgtgagcctttgacaactgcctt

SEQ ID NO: 80936 - DNA, 201 bp, Homo sapiens
caggatgaagaagctggttgggatatttgccttccaggagcttacattccgctgtggggaagcgtgtaagaaacaaacaaagtaaccaatagccagaggamcctcagattttgaaggatcttgaccagttttacttttctacctttacagatcccctatcatgagattgggatgctaaaatcaagacgtgaattggtggaa

SEQ ID NO: 80937 - DNA, 201 bp, Homo sapiens
tttttccactggaatgtttctagagaaatccaagctatcatattattttatcctaaatacttcagtattcatctataattgataagctttttttctttttwtatctaatcattcagccattgttacaaataacaaaattagttattattccctgtcatcatttaatgtgtagtctatattctaaatttcctgtactatctc

SEQ ID NO: 80938 - DNA, 201 bp, Homo sapiens
ttaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactatagta

SEQ ID NO: 80939 - DNA, 201 bp, Homo sapiens
aattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactatag

SEQ ID NO: 80940 - DNA, 201 bp, Homo sapiens
taattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactata

SEQ ID NO: 80941 - DNA, 201 bp, Homo sapiens
ttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactat

SEQ ID NO: 80942 - DNA, 201 bp, Homo sapiens
tgttattgttcaatgtcagccactcttctaactctaggatgcagagactttgcccctctggtgtttatatgttaaccatccttttttttttttttttttttccagatactcgtttgtagtttcataaacattgatgttgggtcaatcatgttctcaatgtatttaaccatgtgtttttaaattttttaatttagttatcaa

SEQ ID NO: 80943 - DNA, 201 bp, Homo sapiens
catccttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtat

SEQ ID NO: 80944 - DNA, 201 bp, Homo sapiens
tgcatccttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagt

SEQ ID NO: 80945 - DNA, 201 bp, Homo sapiens
gtgcatccttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatag

SEQ ID NO: 80946 - DNA, 201 bp, Homo sapiens
ccatataaataaccacaattaacaatgtggtatgtttctgtgttggggaaatcaagaattgcttctatgtctcatggtgtaaaaaaaaaaaaaaaaaaaaagcttaaatccctcagttgtgcaggcatctccatgttctttctctacaaaagggtgagaaatgagtggttccacgcttaggcctaacattgactcgaacag

SEQ ID NO: 80947 - DNA, 201 bp, Homo sapiens
tagaaatcttaaaacaaggatcagacaggttgcaaaaccacaatatctgtcatctgtacattttttctgatactgagcaggggtcagccaaccatagcttytgggacaaataccatgcactgcctttctttgtaaataaagttttattaaaagacagtcaagtccacttgtgtacatattattcataacagcagcgttgag

SEQ ID NO: 80948 - DNA, 201 bp, Homo sapiens
aactcaaacaatggaagaacttgcatttttatggaactcagtattaaaagaaaaatataatgtgaattagccactttgcagaatatgttctagactggtgrtctgaaagcatctgtagttttccttatactatgtatacatttattgtggtaaaatttaaaattaattttaatttaatactagtgtcatagatactttttg

SEQ ID NO: 80949 - DNA, 201 bp, Homo sapiens
aacattgatgttgggtcaatcatgttctcaatgtatttaaccatgtgtttttaaattttttaatttagttatcaaattgagaatctgatggtatggcattwatcaccttgaggaagaacctttatcgtttatctgattttcagatgcatagagctctggctgctttaaaaaataaacctctaaatcatgttcacaaggtag

SEQ ID NO: 80950 - DNA, 201 bp, Homo sapiens
tttgtataagtaatgtcagtaccttgaaaaggactatgtgaaataggaaggatattagattatgaacagctagacgaaaccatcagccagggaggataaayagcatgactatcttggtgttaaaaaaaaaattcaccattcatctgactgccaaaacacctgctgatcaacttactgaggtcaaccacaaggggccaaatc

SEQ ID NO: 80951 - DNA, 201 bp, Homo sapiens
ttttcagcactaatctcaaatgagcctaaataagaattcatcaaattaaggagagtgtacgaatgaaactctaattccatggctcagaaatcagatgatcsgctcgaaactacttgggcttgaatctgtgtttcctaagtgcaaccctgtagacaagctccccaaatgatccgtaccacagctcctttatcctaaaaatga

SEQ ID NO: 80952 - DNA, 201 bp, Homo sapiens
ttagagaagttatcaaaatcattgggagtgttttgttttgttctgcttttctaaatggaggaatggcatgaggggttgcttcttcaaggactgtttcagtmggtttaggatgaggcccagccactgctattctgaaaatgtttcatggctgcatctgaggtgcatccttaattaaaatgctactcaagaggttctgcagag

SEQ ID NO: 80953 - DNA, 201 bp, Homo sapiens
cccagccccagtgtgtgtccttactctattaatttgcctcctttgagaggagggtttttatgcttctttcatcctccccttctccggcacagaacttttgrgtacgagtacagacatgaggagcctaaatgtatgactctgtgaccttgtattccactcatgtacctgggaatatataataagatcatataggaaaatact

SEQ ID NO: 80954 - DNA, 201 bp, Homo sapiens
gtggctttatttccccatgggtgcagtttccttttaagttcctttacttctgatctgtctcaataacctgaaaaagcagaatttcatttacttggagtcakttgccaccagataggcttttctttgataaatggaccccatttttgtgttcttgttcttgaaggaacaatttcctgctgtttaagatttcttaggaggttt

SEQ ID NO: 80955 - DNA, 201 bp, Homo sapiens
tggattgaaggatctctgccacctatcataaggggaaagagaaagcatgcatggttcttgtcataccccagataacttcagaacccattctgtggtttagygttattgagctttcttaatttaaggctgacttgattgatcataaagccaattgaattaaaattctcaccattgtttggttgtggtcattactttgcagcc

SEQ ID NO: 80956 - DNA, 201 bp, Homo sapiens
agcacaaaacggtaaaatccactgtaacggctctaaccttatcggattcactaatacagtgaagatctgcagaaaatccatgtaccacagcttgctcacayatttcttctgcgatggcctttgcctgtccctgctgtgtagcatatagtaacagaaacctcctcatcacttcaaggcatgtaacagtgaaactgaaaaatg

SEQ ID NO: 80957 - DNA, 201 bp, Homo sapiens
gcagtagtaaaacaaacgacactcacagatttttttccatactcatctaacggctaaaattggtgggctgtcaatttgcagagacagatttaaactgaaayccaaaccaaaagcttggctttcggtgaatgaaccgcccagaacggcacctggcatgaaactggtactcgataagttatctgaatgagtgaataaacaata

SEQ ID NO: 80958 - DNA, 201 bp, Homo sapiens
caaacgacactcacagatttttttccatactcatctaacggctaaaattggtgggctgtcaatttgcagagacagatttaaactgaaacccaaaccaaaakcttggctttcggtgaatgaaccgcccagaacggcacctggcatgaaactggtactcgataagttatctgaatgagtgaataaacaatatgaaaacactac

SEQ ID NO: 80959 - DNA, 201 bp, Homo sapiens
gttcagtatggctggggtggcctcaggaaacttacaatcacggcagaaagcaaaggggaagcaaggcaccttcttcacaaggtggcaggaaggagaagcaytgaacaaaaggggaggagccccttataaaaccatcagatcctgtgagaattcactatcacaagaacagcatgggggaaattgcccccaggattcaattat

SEQ ID NO: 80960 - DNA, 201 bp, Homo sapiens
gatttctatccaaatgcaatttcttccttcaaccaacatttaagggccacccttaagagctacattgcctgagtttgaaccctagctctgccacttaaccmcctgcataaactgggcaaagtaactttgtgcttcaacttcttcctcgtgtaaaatgatagtaaaagtactgaatctgtgtaagttaatagaatacctaca

SEQ ID NO: 80961 - DNA, 201 bp, Homo sapiens
atagagagatataaggttgctggtgtcactaacgagcaaatttgacaagctttgtcaaatcataaagctaagtccttttaaactgaattctcatgctgatraattcattggtatgtctatacctgtacaaacaaaagtgatctgaatgtgtcagttgcaattacatattcaatatgatggctcttgcaactatatatttga

SEQ ID NO: 80962 - DNA, 201 bp, Homo sapiens
taaaatccactgtaacggctctaaccttatcggattcactaatacagtgaagatctgcagaaaatccatgtaccacagcttgctcacatatttcttctgcratggcctttgcctgtccctgctgtgtagcatatagtaacagaaacctcctcatcacttcaaggcatgtaacagtgaaactgaaaaatgggggaaaaaaga

SEQ ID NO: 80963 - DNA, 201 bp, Homo sapiens
caggcactgttctagacattggggatacaggatgaagaagctggttgggatatttgccttccaggagcttacattccgctgtggggaagcgtgtaagaaamaaacaaagtaaccaatagccagaggaacctcagattttgaaggatcttgaccagttttacttttctacctttacagatcccctatcatgagattgggatg

SEQ ID NO: 80964 - DNA, 201 bp, Homo sapiens
ggaaacatttaccccggaggatattgtggccctttatagaatcttgcaggcatgtactgaaaaagtggatgaacaccaaacatttttaaataagataaacracttttccctatcaatagtttccaacctgagtcctaaattgattagccaaatgctcactgccctggtggttcttgatcaaagtcaagcatttcctctgat

SEQ ID NO: 80965 - DNA, 201 bp, Homo sapiens
ggaaaagggaaagaagtcatttatttgcttcgttttgcctttttccagtgtaattgattttaagatagaactgaaagaatattcaacacacactctctctyttttttttttttccttaaacagaactttattttctcacagttctggaggctagaagttcaagatcaagatgtctgcaggtttgctttcttctgaggcctc

SEQ ID NO: 80966 - DNA, 201 bp, Homo sapiens
ctgggaaggacgagatgcctggtgtcataaaaagaccatagtcttttttaagtgtgatgcatgcgcacacaggcacgcatacacacacgcgcacacacgcrcacacactgcactgctgccctgtccttggcagacattcctgtggggtcatgttcgaaatatgcacttctgtggagtagcttgggttttcttggaagtctc

SEQ ID NO: 80967 - DNA, 201 bp, Homo sapiens
gggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccac

SEQ ID NO: 80968 - DNA, 201 bp, Homo sapiens
ccccaagtgaaacaggagctagggacaaactgagactgtatgaggactcaccatcaccaggttgaccaaggatacagcgttcagactgatgccccagagcyacataactccaaacatgttgaccaagaccatggcgatggtggcacacatgatgactgcagaccagagctcacagcccaggaggaccatggtcaccagaaa

SEQ ID NO: 80969 - DNA, 201 bp, Homo sapiens
caagtgaaacaggagctagggacaaactgagactgtatgaggactcaccatcaccaggttgaccaaggatacagcgttcagactgatgccccagagccacrtaactccaaacatgttgaccaagaccatggcgatggtggcacacatgatgactgcagaccagagctcacagcccaggaggaccatggtcaccagaaatat

SEQ ID NO: 80970 - DNA, 201 bp, Homo sapiens
aagggcaggctttacctgtaaggaaatactcggtaggcactgccgttaatgcccatggtttcggtgacattactggctataagtcgggctttcttcagagygtcaataaagtcagcagaggtctgcagcacggtgtggtaggtcatgaagtacgtggctccgaccctggtgccatggccaaggaggatgttaactgcagaa

SEQ ID NO: 80971 - DNA, 201 bp, Homo sapiens
ggacgtgtgtttagggaagtcctctgtgttttcagttctgtttttgttttgtttttatgatgggagagatgagcaaatataaaggctgcttctaggagcabgagtgaggagaggttgcctatatgagagaaacgggatggtcaatactgtaggtttttttgagaaggtgaaatatggaattcattttttaaattttttaaa

SEQ ID NO: 80972 - DNA, 201 bp, Homo sapiens
tctgtcacccaggctggagtgcagtgatgtgatctctgctcattgcaacttctgcctcctgtttatataaacaggccaaaccctgtatgtatgtatgtatktatttatttttgagatggagtttcgctcttgttccacttgttgcccaggctggagtgcaatggcacgatcttggctcactgcaacctgcaactcccgggt

SEQ ID NO: 80973 - DNA, 201 bp, Homo sapiens
tcacccaggctggagtgcagtgatgtgatctctgctcattgcaacttctgcctcctgtttatataaacaggccaaaccctgtatgtatgtatgtatttatktatttttgagatggagtttcgctcttgttccacttgttgcccaggctggagtgcaatggcacgatcttggctcactgcaacctgcaactcccgggttcaa

SEQ ID NO: 80974 - DNA, 201 bp, Homo sapiens
ggcaacaagaggaacaagagcaaaactccatcaaataaataaataaataaataaataaaaacagggtttggccttgggcaggatggaccgttttctagaargacagccgtggtgcgctgcacaactggtatgaagcccagtttccatctgaagtcctcgatgttcatggaaataggggcgagacagtctgaggagtgtgaa

SEQ ID NO: 80975 - DNA, 201 bp, Homo sapiens
cgtggtcccagctacttgtgaggctgagatgggaggttgagactgcagtgagccgtgttcgcatcactgctctccagcctgggcacagagacactctgtcyctgaaacaaacaaaaaaagaggggctaacatggtaaatttcatgtttcttatcaagtaaaaaggcttgctgacccacaatctatattaggtttccctgtt

SEQ ID NO: 80976 - DNA, 201 bp, Homo sapiens
gacttgggtagagaggacagaacaatgacagggcaaactggtgatgttgaggaagagtcacagggagcagctaaacaagccagctgcagggatggcactgwgtggctggagagcagggttctggagttatcggtttttccatgtgtgacatgggcctgggtgggtgaggctgagtgtagaagtcttacatttccagtcttg

SEQ ID NO: 80977 - DNA, 201 bp, Homo sapiens
caaactggtgatgttgaggaagagtcacagggagcagctaaacaagccagctgcagggatggcactgtgtggctggagagcagggttctggagttatcggkttttccatgtgtgacatgggcctgggtgggtgaggctgagtgtagaagtcttacatttccagtcttgtcactcctctgatgagtttcagaccaatatatc

SEQ ID NO: 80978 - DNA, 201 bp, Homo sapiens
taggtcactttgagtgagctcatcaaaggaagcatgtcataaatgcaggaaatacttgtgagaggagataaaaatattaaaagagagttgtgatgttaatsacaaattccttctcaagtaagagctagcctgtagggaggaaatgcaaacacaggcttttaaactgatttaaacagcaagatgggatggaatgaaagcaac

SEQ ID NO: 80979 - DNA, 201 bp, Homo sapiens
tggaatctaagacagccaattcccccaagtgaaacaggagctagggacaaactgagactgtatgaggactcaccatcaccaggttgaccaaggatacagcrttcagactgatgccccagagccacataactccaaacatgttgaccaagaccatggcgatggtggcacacatgatgactgcagaccagagctcacagccca

SEQ ID NO: 80980 - DNA, 201 bp, Homo sapiens
ctgatgccccagagccacataactccaaacatgttgaccaagaccatggcgatggtggcacacatgatgactgcagaccagagctcacagcccaggaggamcatggtcaccagaaatatcgcgcccagggacacaccgaggttgaagatagtgtcgtcaatgatggtcaggtactgttcgtagaagacataaaacacactg

SEQ ID NO: 80981 - DNA, 201 bp, Homo sapiens
gaagatagtgtcgtcaatgatggtcaggtactgttcgtagaagacataaaacacactggaggggagaggggaggcctcattaaagctcgctctcactcccraacactgcgtgttcatcctgtcaccactgccaagtggtcagactcctttgggaaacatcccttgcagaaaaccttgctggctgtctacaagactcaccga

SEQ ID NO: 80982 - DNA, 201 bp, Homo sapiens
ctctgggaaggacgagatgcctggtgtcataaaaagaccatagtcttttttaagtgtgatgcatgcgcacacaggcacgcatacacacacgcgcacacacrcgcacacactgcactgctgccctgtccttggcagacattcctgtggggtcatgttcgaaatatgcacttctgtggagtagcttgggttttcttggaagtc

SEQ ID NO: 80983 - DNA, 201 bp, Homo sapiens
gagtcaaccaaactgaattctctgggaaggacgagatgcctggtgtcataaaaagaccatagtcttttttaagtgtgatgcatgcgcacacaggcacgcayacacacacgcgcacacacgcgcacacactgcactgctgccctgtccttggcagacattcctgtggggtcatgttcgaaatatgcacttctgtggagtagc

SEQ ID NO: 80984 - DNA, 201 bp, Homo sapiens
gcataattgttgacgggtggttctggagcgatgtgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatg

SEQ ID NO: 80985 - DNA, 201 bp, Homo sapiens
ggtttcggtgacattactggctataagtcgggctttcttcagagcgtcaataaagtcagcagaggtctgcagcacggtgtggtaggtcatgaagtacgtgrctccgaccctggtgccatggccaaggaggatgttaactgcagaactataggcagcatgtcccctgaggaaagaatcctgggtgtcaagagagtccaggtc

SEQ ID NO: 80986 - DNA, 201 bp, Homo sapiens
atggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgag

SEQ ID NO: 80987 - DNA, 201 bp, Homo sapiens
ttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctga

SEQ ID NO: 80988 - DNA, 201 bp, Homo sapiens
aaacaggagctagggacaaactgagactgtatgaggactcaccatcaccaggttgaccaaggatacagcgttcagactgatgccccagagccacataactmcaaacatgttgaccaagaccatggcgatggtggcacacatgatgactgcagaccagagctcacagcccaggaggaccatggtcaccagaaatatcgcgcc

SEQ ID NO: 80989 - DNA, 201 bp, Homo sapiens
ctggctaatttttaaacttttttgtagagacgaagtcttgctatgttgcccaggctggtgtcaaactcctaacctcaactcctgccttggccactcagctytagtctcttgctggggattttattctttttttttttttttataattgcaagtaataaattaaaaaaaaaaaaaagaaaagaaaaagggcttggtggcccg

SEQ ID NO: 80990 - DNA, 201 bp, Homo sapiens
ctaatttttaaacttttttgtagagacgaagtcttgctatgttgcccaggctggtgtcaaactcctaacctcaactcctgccttggccactcagctttagyctcttgctggggattttattctttttttttttttttataattgcaagtaataaattaaaaaaaaaaaaaagaaaagaaaaagggcttggtggcccgtgcc

SEQ ID NO: 80991 - DNA, 201 bp, Homo sapiens
aaaaatgaacaagatcatgtcttttgtgggaacatggatggagctggaggccatcatccttagcaaactaacacaggaacagaaaaccaaataccacatgwtctcacttctaagtgggagctaaatgtaagttatgaatgcaaagaaggaaacaacagacacggggggctacttgagcaggggagggtgggaggagggaga

SEQ ID NO: 80992 - DNA, 201 bp, Homo sapiens
agaagaggtggggtttcaccatgttggccaggctggtcttgaacccctggcctcaaataatccacctatctcggccccctaaagtgctgggattacaggcrtgagccaccatgcctggccgaaagacattttaatttgcattttacattactagggaagtaagcatcttttcatttgtatattgtccatttgtattttgtt

SEQ ID NO: 80993 - DNA, 201 bp, Homo sapiens
tgggttcaggcgattctcctgtctcagcttcctgaatagctgggattacaggtgtgcgccaccacgcctggctaatttttgtatttttggtagagatgggrtttcaccatgttggccaagctggtcttgaactcctgacttcaggtgatccactcacctcagcctcccaaagtgctgggattacaggcgtgagccactgtg

SEQ ID NO: 80994 - DNA, 201 bp, Homo sapiens
gcctcaagtgatctgcccaccttggcctctcaaagtggtgggattacaggcatgagccaccacgcctggcccaaatttttatatttttggtagagatgggrtttcaccatgttggccagactggtcttgaactcctgacctcaggtgatccgcctgcctcgctctcccaaagtgctaggattacaagtgtgagccaccatg

SEQ ID NO: 80995 - DNA, 201 bp, Homo sapiens
ctttcttctgtgcctgtccctcgcagcagtctctcccggctctcttttgaaggagattggagtgcagaattggctagtctgaggtttcagtgtgcaagacrtagtcagatggctcacatttggaaccctggtagtaatgttttattctttgtccgatggcattgggcgggttgacccagcctgcagtcaggatttccttgt

SEQ ID NO: 80996 - DNA, 201 bp, Homo sapiens
tcactgtcttagaagatgactcatatgctaagacaggtctgcctccctgactcagaatgctgagtgactcctgacattattagttggaatgggaagtgtamggtcaagttggggtctttacctgcatgacgaaaccacttcttgtaatgacagacttttactgtgttggttagaatagccagtccttggggagcctctagt

SEQ ID NO: 80997 - DNA, 201 bp, Homo sapiens
gaattgcttgagaccagcctggacaacagagtgagaccacatctctctccctctcttttggagatgggctctttgctttcttcctcaggctgcagtgcagyggtatgaacacgactcactgcatcctaagcccacccttctgggctcaagcaagcttcctgcctcagcctaacaagtaggtgggactgcagacgcacacca

SEQ ID NO: 80998 - DNA, 201 bp, Homo sapiens
gtctgaggagtgtgaagaaggcctgaaaatatccttgcagagaacaggagagacaatgactgggacagccaggcagggctgagggcccatttgaatttccmgcagtgccctctgtcctgttgtgtgacccctccagcagtaggtactgggaaagcaggtggctgagttcatccaggactgaggctctgccagacaagaaca

SEQ ID NO: 80999 - DNA, 201 bp, Homo sapiens
accagcctggacaacagagtgagaccacatctctctccctctcttttggagatgggctctttgctttcttcctcaggctgcagtgcagtggtatgaacacsactcactgcatcctaagcccacccttctgggctcaagcaagcttcctgcctcagcctaacaagtaggtgggactgcagacgcacaccacttcacctggct

SEQ ID NO: 81000 - DNA, 201 bp, Homo sapiens
agacataaaacacactggaggggagaggggaggcctcattaaagctcgctctcactcccgaacactgcgtgttcatcctgtcaccactgccaagtggtcaractcctttgggaaacatcccttgcagaaaaccttgctggctgtctacaagactcaccgaaagcaactcacttgacctctcatggccactgaccacccaga

SEQ ID NO: 81001 - DNA, 201 bp, Homo sapiens
tttcttaaaaggaactagtatattagattgtaatagaactactttctatcccccggagatgataaaaagcccctcattttcttaatcttctacttcagtgsttcaatttagtgacaaagctataaatgaagcaaatcagtattgttctttcaaccgtgggtcatttttgtgcaaggtgaagtggccatagaagtaaaagga

SEQ ID NO: 81002 - DNA, 201 bp, Homo sapiens
gaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaa

SEQ ID NO: 81003 - DNA, 201 bp, Homo sapiens
acttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccaca

SEQ ID NO: 81004 - DNA, 201 bp, Homo sapiens
tcacagcccaggaggaccatggtcaccagaaatatcgcgcccagggacacaccgaggttgaagatagtgtcgtcaatgatggtcaggtactgttcgtagargacataaaacacactggaggggagaggggaggcctcattaaagctcgctctcactcccgaacactgcgtgttcatcctgtcaccactgccaagtggtcag

SEQ ID NO: 81005 - DNA, 201 bp, Homo sapiens
cctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagtt

SEQ ID NO: 81006 - DNA, 201 bp, Homo sapiens
ctgagcacttgaggctaagcaaaatcacctgaccctggactcagaggtcagacccagctgtacatttcagggatgaagaaggcccccagataagggaacascaaaggtttagcttgttctctcccagactggcttctttttttttttattttgagacagagtcttgctctgtagcccaggctggagtgcagtggcgtgatc

SEQ ID NO: 81007 - DNA, 201 bp, Homo sapiens
ccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccag

SEQ ID NO: 81008 - DNA, 201 bp, Homo sapiens
actctgtatcctttactaaggtgtggcaccgtgcacaacagggcaagtggtcaccctcagagagtggtcctgaagtcctcctccgggcagctgtgaataamactccgagagccaccccgcaggcagcttccctgactgtccaggggcctcgcgtttagcgtggactcagtacatggtgggcaggggcgagtgctagcggaa

SEQ ID NO: 81009 - DNA, 201 bp, Homo sapiens
aggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggt

SEQ ID NO: 81010 - DNA, 201 bp, Homo sapiens
tcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatc

SEQ ID NO: 81011 - DNA, 201 bp, Homo sapiens
gcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgt

SEQ ID NO: 81012 - DNA, 201 bp, Homo sapiens
attagaataaggtcgctgagatttgccgcctgccatagggcaaggtggcagtagtgggggatagtggaggagtagtaaattcagggtccctgcatcccackagctggcggctgcatctcacttcataccttcactgtttttgtttttcccatctgtgtttgatcttgcctgtagatccttggtctactgttatagatgaga

SEQ ID NO: 81013 - DNA, 201 bp, Homo sapiens
agacagggagaaatattaatccgtgagtggctcccagtaagaccatggccaaatacatcctgaagtagaatatctggaaaatttgagatttggcaaaagcsaacaccacaatccctccaaattttgtaagtgtgattccactgaacacctaaaagaagagatactgtgttagaaaccacttttaccaacctgtaattgaac

SEQ ID NO: 81014 - DNA, 201 bp, Homo sapiens
agtgattctcctgcttcagcttcccaagtagctgggattagaggcgcccaccaccacgcccggctaattttttttgtatttttagtagagatggggtttcrccgtgttggccaggctggtttcgaactcctgacctcaaaacgatccgcccgcctcagactcccacagtgctaggattacaggcatgagccgctgcacccg

SEQ ID NO: 81015 - DNA, 201 bp, Homo sapiens
cagagaacgctgtctctacaaagcataataataaaaaaatgagccaggtgtggtggcatgcacccgtggtcccagctacttgtgaggctgagatgggaggytgagactgcagtgagccgtgttcgcatcactgctctccagcctgggcacagagacactctgtctctgaaacaaacaaaaaaagaggggctaacatggtaa

SEQ ID NO: 81016 - DNA, 201 bp, Homo sapiens
actgaattctctgggaaggacgagatgcctggtgtcataaaaagaccatagtcttttttaagtgtgatgcatgcgcacacaggcacgcatacacacacgcrcacacacgcgcacacactgcactgctgccctgtccttggcagacattcctgtggggtcatgttcgaaatatgcacttctgtggagtagcttgggttttct

SEQ ID NO: 81017 - DNA, 201 bp, Homo sapiens
ggcagcttccctgactgtccaggggcctcgcgtttagcgtggactcagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcag

SEQ ID NO: 81018 - DNA, 201 bp, Homo sapiens
agcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacag

SEQ ID NO: 81019 - DNA, 201 bp, Homo sapiens
tcacaacttcttttcttggacctcagtgctcccctatctgaagcagggctcatatctgagagtacggatacactgttctattttccatgaataccttctcragtgctctcatctttaatgattaaaagtacctgataaccacataggaggcaaaaggcactggtcggagagctcctggggcggggtgcaattttctaagta

SEQ ID NO: 81020 - DNA, 201 bp, Homo sapiens
aaaagaatgcctcaggatagaattccctttcagtaatgtccttctattgtgccacccttttaagatgagaactcttacctatgtaactgagtaagacaggragaaatattaatccgtgagtggctcccagtaagaccatggccaaatacatcctgaagtagaatatctggaaaatttgagatttggcaaaagccaacacca

SEQ ID NO: 81021 - DNA, 201 bp, Homo sapiens
gcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcc

SEQ ID NO: 81022 - DNA, 201 bp, Homo sapiens
gtccagtggtaaaccgaccgacccttagacacagttcagtcaggatgccctgcgagagggctagaaatttagaagccgttcgcgctctgttcctttgtatygctcttcagtggcacaacttttggctttatttactgatggccctatgagagagagagactttttcttatttctgcaggagaaagggagctagttggctgg

SEQ ID NO: 81023 - DNA, 201 bp, Homo sapiens
tctatcccccggagatgataaaaagcccctcattttcttaatcttctacttcagtgcttcaatttagtgacaaagctataaatgaagcaaatcagtattgytctttcaaccgtgggtcatttttgtgcaaggtgaagtggccatagaagtaaaaggatcaaggacagtctcgagatgaagaaaggcagcaagcactttgct

SEQ ID NO: 81024 - DNA, 201 bp, Homo sapiens
catctttagggtttacatggaatctaagacagccaattcccccaagtgaaacaggagctagggacaaactgagactgtatgaggactcaccatcaccaggytgaccaaggatacagcgttcagactgatgccccagagccacataactccaaacatgttgaccaagaccatggcgatggtggcacacatgatgactgcaga

SEQ ID NO: 81025 - DNA, 201 bp, Homo sapiens
gagctcacagcccaggaggaccatggtcaccagaaatatcgcgcccagggacacaccgaggttgaagatagtgtcgtcaatgatggtcaggtactgttcgyagaagacataaaacacactggaggggagaggggaggcctcattaaagctcgctctcactcccgaacactgcgtgttcatcctgtcaccactgccaagtgg

SEQ ID NO: 81026 - DNA, 201 bp, Homo sapiens
tgctgggtaaaccccattgaaaaagggcaggctttacctgtaaggaaatactcggtaggcactgccgttaatgcccatggtttcggtgacattactggctrtaagtcgggctttcttcagagcgtcaataaagtcagcagaggtctgcagcacggtgtggtaggtcatgaagtacgtggctccgaccctggtgccatggcc

SEQ ID NO: 81027 - DNA, 201 bp, Homo sapiens
catggtttcggtgacattactggctataagtcgggctttcttcagagcgtcaataaagtcagcagaggtctgcagcacggtgtggtaggtcatgaagtacrtggctccgaccctggtgccatggccaaggaggatgttaactgcagaactataggcagcatgtcccctgaggaaagaatcctgggtgtcaagagagtccag

SEQ ID NO: 81028 - DNA, 201 bp, Homo sapiens
acgtccgttctgtccacgatgtggcagctaattcatgaattgcctgaaagcttgcaatccttagaagctgctttgtaagtacaggatccagactcttcagycactgaggaggattactttgtggtgcgactctgccggcgtggccctgctcagggtactcacggagctgcccatgtgggcaagtgcctcttccgcgcgctc

SEQ ID NO: 81029 - DNA, 201 bp, Homo sapiens
acgcgggggtacaggttggggcaggggcgaccgagccgggcacaggaactcgcagcagggtagggttggcggctacgccgccctcggtccgcggggaaccrcgcgggcttccgggtcacgccgccgcgttccgaccgccctcggggagaggggaggagcctccagcgccgggcggggcgtggttaaggccggtgggcccca

SEQ ID NO: 81030 - DNA, 201 bp, Homo sapiens
acggagctgcccatgtgggcaagtgcctcttccgcgcgctccacgcggctgcctttcatgctcaccgtgaacgctctggttatgtggctgcagaactccayggagatgccacagctctgaaataaagcacttcctttaggatggctctcttcctgttgaagaccctaggcagccaccccgttctgaggatgggtgctaatt

SEQ ID NO: 81031 - DNA, 201 bp, Homo sapiens
cctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgttt

SEQ ID NO: 81032 - DNA, 201 bp, Homo sapiens
cctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgat

SEQ ID NO: 81033 - DNA, 201 bp, Homo sapiens
cagggaataagcagtaaagattcctctgggagtggcaccctctctgtacccgggtcagaaaatagcccttatcaccagagactgggagttggggctgcaayggacctgaataaatgaacttcccaagtaacacttaccttccactaattttacaccctccccaatatttctcctagtgactctcttagaaatgtatcgccc

SEQ ID NO: 81034 - DNA, 201 bp, Homo sapiens
agtggctcccagtaagaccatggccaaatacatcctgaagtagaatatctggaaaatttgagatttggcaaaagccaacaccacaatccctccaaattttbtaagtgtgattccactgaacacctaaaagaagagatactgtgttagaaaccacttttaccaacctgtaattgaacaaaaacacttccttacaaggatttc

SEQ ID NO: 81035 - DNA, 201 bp, Homo sapiens
cctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcag

SEQ ID NO: 81036 - DNA, 201 bp, Homo sapiens
aaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaacc

SEQ ID NO: 81037 - DNA, 201 bp, Homo sapiens
cctttcagtaatgtccttctattgtgccacccttttaagatgagaactcttacctatgtaactgagtaagacagggagaaatattaatccgtgagtggctyccagtaagaccatggccaaatacatcctgaagtagaatatctggaaaatttgagatttggcaaaagccaacaccacaatccctccaaattttgtaagtgt

SEQ ID NO: 81038 - DNA, 201 bp, Homo sapiens
ttagctgttcatggaagggtaagaggtctgagacaggcactgaagagggccagttgctgggacagtgtccattcctacgctgccagacgtgagggatggcygagtccttttggactctattgctgtgggtgttctgggctgtgggaatcagtaggtctgatcccaaatggcagtttctgtgccgtcccacacggtctgctg

SEQ ID NO: 81039 - DNA, 201 bp, Homo sapiens
gtgctaattacccagggcaccctgggtgctagaggaggccaagcatcccattggacttacaaggcctccatcacaccaatcttactgtaccaggaactttytggggccctctctacacacagccaaaagcctggttttctgtggcacgtttgtgttgaccaggagaaattgctggaacccgttaaggtcaccccacccgca

SEQ ID NO: 81040 - DNA, 201 bp, Homo sapiens
gggcaaataatcaaactgttttaatgcagaaaaaaatgtgcaacagaaagagatagctcatggagggataaagactttattctggaccctctagattctgkggggcctgcagtagcttcaagatgccccagcatgtcctgcgcccacacccctgtcaagatcactgtggtcagggcgtcttgcccatggccagtgtattag

SEQ ID NO: 81041 - DNA, 201 bp, Homo sapiens
cagcccgctcctcaagaggccggtgcggacccaggcggtgctggaccagtcagatgtgtacacccatgtcctgtcagccttcgtggaaaagaaggtgggcygcagctttccgcctcttctggactgagaatgctcaaaacaaggaagttgctgaaaacgaggagacttcatgtgattagagtcacttgaagtgattagaat

SEQ ID NO: 81042 - DNA, 201 bp, Homo sapiens
aagcagggcagagccgaagcagcccgctcctcaagaggccggtgcggacccaggcggtgctggaccagtcagatgtgtacacccatgtcctgtcagccttygtggaaaagaaggtgggccgcagctttccgcctcttctggactgagaatgctcaaaacaaggaagttgctgaaaacgaggagacttcatgtgattagagt

SEQ ID NO: 81043 - DNA, 201 bp, Homo sapiens
aggctaagccagggtgtagagttgaaccaagacgactctccaggcaccaaccgcacatcacacgctgggttctggcccgggctcccctgcattttaaatgrgaaagactgccagctgtctcatgtttaacttgtctgttattttcctgcttcagcacactgccacctaaaaaggagccgtaccaacaggtacagttccaca

SEQ ID NO: 81044 - DNA, 201 bp, Homo sapiens
cagagctcacagcccaggaggaccatggtcaccagaaatatcgcgcccagggacacaccgaggttgaagatagtgtcgtcaatgatggtcaggtactgttygtagaagacataaaacacactggaggggagaggggaggcctcattaaagctcgctctcactcccgaacactgcgtgttcatcctgtcaccactgccaagt

SEQ ID NO: 81045 - DNA, 201 bp, Homo sapiens
cataaatgcaggaaatacttgtgagaggagataaaaatattaaaagagagttgtgatgttaatgacaaattccttctcaagtaagagctagcctgtagggwggaaatgcaaacacaggcttttaaactgatttaaacagcaagatgggatggaatgaaagcaactgggcaaaccatgattgattttggcctcagtcttgtc

SEQ ID NO: 81046 - DNA, 201 bp, Homo sapiens
gtcaccctcagagagtggtcctgaagtcctcctccgggcagctgtgaataacactccgagagccaccccgcaggcagcttccctgactgtccaggggcctygcgtttagcgtggactcagtacatggtgggcaggggcgagtgctagcggaaactgggtttgctttttgttttcatcttttcctggtttagaatttcctat

SEQ ID NO: 81047 - DNA, 201 bp, Homo sapiens
gcaagactccgtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaa

SEQ ID NO: 81048 - DNA, 201 bp, Homo sapiens
aatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaacccc

SEQ ID NO: 81049 - DNA, 201 bp, Homo sapiens
ctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccat

SEQ ID NO: 81050 - DNA, 201 bp, Homo sapiens
tggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaatt

SEQ ID NO: 81051 - DNA, 201 bp, Homo sapiens
tcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttt

SEQ ID NO: 81052 - DNA, 201 bp, Homo sapiens
tgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttgg

SEQ ID NO: 81053 - DNA, 201 bp, Homo sapiens
cattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttaga

SEQ ID NO: 81054 - DNA, 201 bp, Homo sapiens
ttcagtccttgtggatgaactgtaaacagcacccttcctctaagatgccgaagatcatagtttgtggtttttttctttcaggcggtggaagcagggcagarccgaagcagcccgctcctcaagaggccggtgcggacccaggcggtgctggaccagtcagatgtgtacacccatgtcctgtcagccttcgtggaaaagaag

SEQ ID NO: 81055 - DNA, 201 bp, Homo sapiens
gggtattttctaagtaattatgatgcaaaattgtttcctatatattagaataaggtcgctgagatttgccgcctgccatagggcaaggtggcagtagtggkggatagtggaggagtagtaaattcagggtccctgcatcccacgagctggcggctgcatctcacttcataccttcactgtttttgtttttcccatctgtgt

SEQ ID NO: 81056 - DNA, 201 bp, Homo sapiens
gtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactg

SEQ ID NO: 81057 - DNA, 201 bp, Homo sapiens
cattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaat

SEQ ID NO: 81058 - DNA, 201 bp, Homo sapiens
aacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccttgactacaattgaataaacatttcgtaatgacattaaa

SEQ ID NO: 81059 - DNA, 201 bp, Homo sapiens
catgctttctttttcttggtgagattttcctggattgtcagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgca

SEQ ID NO: 81060 - DNA, 201 bp, Homo sapiens
tagctgttcatggaagggtaagaggtctgagacaggcactgaagagggccagttgctgggacagtgtccattcctacgctgccagacgtgagggatggctragtccttttggactctattgctgtgggtgttctgggctgtgggaatcagtaggtctgatcccaaatggcagtttctgtgccgtcccacacggtctgctgg

SEQ ID NO: 81061 - DNA, 201 bp, Homo sapiens
agtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcacttttta

SEQ ID NO: 81062 - DNA, 201 bp, Homo sapiens
gaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagagagttatatgcagcctcttttgcacctcgttg

SEQ ID NO: 81063 - DNA, 201 bp, Homo sapiens
taatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctt

SEQ ID NO: 81064 - DNA, 201 bp, Homo sapiens
ttactcagtatcatttatcattatcaaatgaccattagtatgagttcaaatacttgaaaagaatgcctcaggatagaattccctttcagtaatgtccttcyattgtgccacccttttaagatgagaactcttacctatgtaactgagtaagacagggagaaatattaatccgtgagtggctcccagtaagaccatggccaa

SEQ ID NO: 81065 - DNA, 201 bp, Homo sapiens
agtgacttaaaaaattttactgttggtctgtgttaatgagaaactgtccttttttgagagggagcctccctctgttccccagggtggagtgcagtggtgcratcttggctgactgcaacctccgcctcccaggttcaagtgattctcctgcttcagcttcccaagtagctgggattagaggcgcccaccaccacgcccggc

SEQ ID NO: 81066 - DNA, 201 bp, Homo sapiens
caaattttgtaagtgtgattccactgaacacctaaaagaagagatactgtgttagaaaccacttttaccaacctgtaattgaacaaaaacacttccttacraggatttctcccaggttcaagtgattctcctgccccagcctcctgagtagctgggattaaacaggtgcacgccaccatgcctggctaatttttgtgtttt

SEQ ID NO: 81067 - DNA, 201 bp, Homo sapiens
tgatgtgatctcggctcactgcagcctcgatctctcaggctcaagtgattctctcgcctcagtctcccttaaaaattgttaaaaaataatttggaacttcrtgtgtcttttgtattgcttgatagcagcatagaatatgtgaggtatttttggctactttgtgaattagccttttcatctctcatttctgagtgctagatc

SEQ ID NO: 81068 - DNA, 201 bp, Homo sapiens
gaaaaaaaacccctaacaatataaaaagtctacatacaggcagcatcccaaataaccagcagttagggattctggttcattgttggccaagaatgtgggcygggccctgctctgagccgcctgctctccaagcgccccctgccttaagccattttccagtgtgtgtctcttgcagctgtgcagtggcgcagagatcaagtt

SEQ ID NO: 81069 - DNA, 201 bp, Homo sapiens
ttttccatgaataccttctcgagtgctctcatctttaatgattaaaagtacctgataaccacataggaggcaaaaggcactggtcggagagctcctggggyggggtgcaattttctaagtaaaaagtgaacatcctgctgtcatcaggctacaggcttgtgcaatctctaaagaataacaaattacaggcagactagccca

SEQ ID NO: 81070 - DNA, 201 bp, Homo sapiens
taccagagaaacggagtctgaaactcttgaagagccacaatctcaatgtgaattggtacatgtactgccccgagagcgccgtgatcttgctgtctaccacrgtcctggagaatgtcctgcagccttttcactttagggtaagaggaagcctcccctgaaaaaaacacctttccccagttgtcccctgttcctgtagcatcc

SEQ ID NO: 81071 - DNA, 201 bp, Homo sapiens
gggtccacatcgaagaattcagtccttgtggatgaactgtaaacagcacccttcctctaagatgccgaagatcatagtttgtggtttttttctttcaggcrgtggaagcagggcagagccgaagcagcccgctcctcaagaggccggtgcggacccaggcggtgctggaccagtcagatgtgtacacccatgtcctgtcag

SEQ ID NO: 81072 - DNA, 201 bp, Homo sapiens
ggtcctgaagtcctcctccgggcagctgtgaataacactccgagagccaccccgcaggcagcttccctgactgtccaggggcctcgcgtttagcgtggacycagtacatggtgggcaggggcgagtgctagcggaaactgggtttgctttttgttttcatcttttcctggtttagaatttcctataacatgtggattcttc

SEQ ID NO: 81073 - DNA, 201 bp, Homo sapiens
atctaagtagagaaagtgttttccgctcatatcctgggtccacatcgaagaattcagtccttgtggatgaactgtaaacagcacccttcctctaagatgcygaagatcatagtttgtggtttttttctttcaggcggtggaagcagggcagagccgaagcagcccgctcctcaagaggccggtgcggacccaggcggtgct

SEQ ID NO: 81074 - DNA, 201 bp, Homo sapiens
tcctgcttgccaaagaatgaggtttctttcctgaagaggctgggagaagtttagtgtcctgtggttgcctccagatctagtaatactgcttcccaagtcarctgtgcattcctgagttcacaggcgctacgttcaaagctgctgccaaacaaccgatggttggcaccatccggtgttcaacttggccttgccgatgcagca

SEQ ID NO: 81075 - DNA, 201 bp, Homo sapiens
aaaaaattgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcct

SEQ ID NO: 81076 - DNA, 201 bp, Homo sapiens
atcgcgcccagggacacaccgaggttgaagatagtgtcgtcaatgatggtcaggtactgttcgtagaagacataaaacacactggaggggagaggggaggyctcattaaagctcgctctcactcccgaacactgcgtgttcatcctgtcaccactgccaagtggtcagactcctttgggaaacatcccttgcagaaaacct

SEQ ID NO: 81077 - DNA, 201 bp, Homo sapiens
tctctgctcattgcaacttctgcctcctgtttatataaacaggccaaaccctgtatgtatgtatgtatttatttatttttgagatggagtttcgctcttgktccacttgttgcccaggctggagtgcaatggcacgatcttggctcactgcaacctgcaactcccgggttcaagcgattctcctgcctcagcctcccaagt

SEQ ID NO: 81078 - DNA, 201 bp, Homo sapiens
aggggcgaccgagccgggcacaggaactcgcagcagggtagggttggcggctacgccgccctcggtccgcggggaaccacgcgggcttccgggtcacgccrccgcgttccgaccgccctcggggagaggggaggagcctccagcgccgggcggggcgtggttaaggccggtgggccccaccgcagccagacgctgcccgtt

SEQ ID NO: 81079 - DNA, 201 bp, Homo sapiens
gttcaaatacttgaaaagaatgcctcaggatagaattccctttcagtaatgtccttctattgtgccacccttttaagatgagaactcttacctatgtaacygagtaagacagggagaaatattaatccgtgagtggctcccagtaagaccatggccaaatacatcctgaagtagaatatctggaaaatttgagatttggca

SEQ ID NO: 81080 - DNA, 201 bp, Homo sapiens
aagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattc

SEQ ID NO: 81081 - DNA, 201 bp, Homo sapiens
gtaaaccccattgaaaaagggcaggctttacctgtaaggaaatactcggtaggcactgccgttaatgcccatggtttcggtgacattactggctataagtygggctttcttcagagcgtcaataaagtcagcagaggtctgcagcacggtgtggtaggtcatgaagtacgtggctccgaccctggtgccatggccaaggag

SEQ ID NO: 81082 - DNA, 201 bp, Homo sapiens
aggggaatgttgtatataaacttttgcagctagctttttttttttttgtccaaagtgtatcttggacatctttctatattttattctgactgggtagtatyccactgtatggatggactgcagtttaaaaattttcttgttattggacattggctggttttccatttttttgtgattacaaataacccttcagtaacatgc

SEQ ID NO: 81083 - DNA, 201 bp, Homo sapiens
gctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagtttt

SEQ ID NO: 81084 - DNA, 201 bp, Homo sapiens
ttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaa

SEQ ID NO: 81085 - DNA, 201 bp, Homo sapiens
aggagttcaagaccagcctggccaacatggcgaaaccccatctgtactaaaaatacaaaaaattagctgggcgtggtggcacttgcctgtaaacccaggtwctcgggagattgaggctggagactcacttgaacccaggaggcggaggttgcagtgagctgagattgtgccactgcactccagcctgggcaacagagtgag

SEQ ID NO: 81086 - DNA, 201 bp, Homo sapiens
ttttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataacactccgagagccacccc

SEQ ID NO: 81087 - DNA, 201 bp, Homo sapiens
aggttgcagtgagctgagattgtgccactgcactccagcctgggcaacagagtgagactccatcacaaacaaacaaacaaacataatttggcaggtagggkctcaggaagcagagtgctgattggtcaaggttggagatggaatcctaggggggtcgaactgaggttttcttgctgttttctactcctagatgggatggca

SEQ ID NO: 81088 - DNA, 201 bp, Homo sapiens
taggaggcaaaaggcactggtcggagagctcctggggcggggtgcaattttctaagtaaaaagtgaacatcctgctgtcatcaggctacaggcttgtgcartctctaaagaataacaaattacaggcagactagcccagaactaggccaggaaatcacatttccatggtcagaggcaccatcaggtatactagtatagccg

SEQ ID NO: 81089 - DNA, 201 bp, Homo sapiens
tctgagcacttgaggctaagcaaaatcacctgaccctggactcagaggtcagacccagctgtacatttcagggatgaagaaggcccccagataagggaacrccaaaggtttagcttgttctctcccagactggcttctttttttttttattttgagacagagtcttgctctgtagcccaggctggagtgcagtggcgtgat

SEQ ID NO: 81090 - DNA, 201 bp, Homo sapiens
caaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttc

SEQ ID NO: 81091 - DNA, 201 bp, Homo sapiens
gtgtgagccacttcgcctggccagatgggcttttctcgattgctctgggttctttggtacatagctgctgtttctccacctggtttcatgtataatcaaakgtacagggtttactcagtcctgttgtgtaataggaagcaggaaagggcaagggccctgggaacaacctcagccctgccacttactggtcatgtaaccccg

SEQ ID NO: 81092 - DNA, 201 bp, Homo sapiens
ggccctgggaacaacctcagccctgccacttactggtcatgtaaccccgagcaaaatgaccacctctgagccccagtctcctcttctgtaaatgggtatamcaccacctactcataggctgcgtgatgagaaatggaataatgtcagggagtgcctggcatgacgctggcaccctggaggctccccaggaacggtggctac

SEQ ID NO: 81093 - DNA, 201 bp, Homo sapiens
ccaaactgaattctctgggaaggacgagatgcctggtgtcataaaaagaccatagtcttttttaagtgtgatgcatgcgcacacaggcacgcatacacacrcgcgcacacacgcgcacacactgcactgctgccctgtccttggcagacattcctgtggggtcatgttcgaaatatgcacttctgtggagtagcttgggtt

SEQ ID NO: 81094 - DNA, 201 bp, Homo sapiens
ctagggacaaactgagactgtatgaggactcaccatcaccaggttgaccaaggatacagcgttcagactgatgccccagagccacataactccaaacatgwtgaccaagaccatggcgatggtggcacacatgatgactgcagaccagagctcacagcccaggaggaccatggtcaccagaaatatcgcgcccagggacac

SEQ ID NO: 81095 - DNA, 201 bp, Homo sapiens
acagggagaaatattaatccgtgagtggctcccagtaagaccatggccaaatacatcctgaagtagaatatctggaaaatttgagatttggcaaaagccamcaccacaatccctccaaattttgtaagtgtgattccactgaacacctaaaagaagagatactgtgttagaaaccacttttaccaacctgtaattgaacaa

SEQ ID NO: 81096 - DNA, 201 bp, Homo sapiens
accatggccaaatacatcctgaagtagaatatctggaaaatttgagatttggcaaaagccaacaccacaatccctccaaattttgtaagtgtgattccacygaacacctaaaagaagagatactgtgttagaaaccacttttaccaacctgtaattgaacaaaaacacttccttacaaggatttctcccaggttcaagtga

SEQ ID NO: 81097 - DNA, 201 bp, Homo sapiens
gacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaac

SEQ ID NO: 81098 - DNA, 201 bp, Homo sapiens
gatagaattccctttcagtaatgtccttctattgtgccacccttttaagatgagaactcttacctatgtaactgagtaagacagggagaaatattaatccrtgagtggctcccagtaagaccatggccaaatacatcctgaagtagaatatctggaaaatttgagatttggcaaaagccaacaccacaatccctccaaatt

SEQ ID NO: 81099 - DNA, 201 bp, Homo sapiens
ttgtggtgcgactctgccggcgtggccctgctcagggtactcacggagctgcccatgtgggcaagtgcctcttccgcgcgctccacgcggctgcctttcaygctcaccgtgaacgctctggttatgtggctgcagaactccacggagatgccacagctctgaaataaagcacttcctttaggatggctctcttcctgttga

SEQ ID NO: 81100 - DNA, 201 bp, Homo sapiens
tgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttca

SEQ ID NO: 81101 - DNA, 201 bp, Homo sapiens
agcagaggtctgcagcacggtgtggtaggtcatgaagtacgtggctccgaccctggtgccatggccaaggaggatgttaactgcagaactataggcagcaygtcccctgaggaaagaatcctgggtgtcaagagagtccaggtcttgcaaaatatcagcagaatctgagcacttgaggctaagcaaaatcacctgaccctg

SEQ ID NO: 81102 - DNA, 201 bp, Homo sapiens
gtcaagactgactcctgttcactgtgaagtagaggaaggcagtgatagccagacagggacgtgtgtttagggaagtcctctgtgttttcagttctgttttygttttgtttttatgatgggagagatgagcaaatataaaggctgcttctaggagcaggagtgaggagaggttgcctatatgagagaaacgggatggtcaat

SEQ ID NO: 81103 - DNA, 201 bp, Homo sapiens
ctggtaacacatggaacctcaaagtagaaatgtctgttgttcatttttaaaagactatttgcagagttttgatgtttatcaatgaaaagagtttttttttwaaatttatgaagaatagggaatcctatatgggcatggggcaaataatcaaactgttttaatgcagaaaaaaatgtgcaacagaaagagatagctcatgga

SEQ ID NO: 81104 - DNA, 201 bp, Homo sapiens
tgggtcaagactgactcctgttcactgtgaagtagaggaaggcagtgatagccagacagggacgtgtgtttagggaagtcctctgtgttttcagttctgtktttgttttgtttttatgatgggagagatgagcaaatataaaggctgcttctaggagcaggagtgaggagaggttgcctatatgagagaaacgggatggtc

SEQ ID NO: 81105 - DNA, 201 bp, Homo sapiens
gaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcaatatgtgag

SEQ ID NO: 81106 - DNA, 201 bp, Homo sapiens
ttctctgggaaggacgagatgcctggtgtcataaaaagaccatagtcttttttaagtgtgatgcatgcgcacacaggcacgcatacacacacgcgcacacrcgcgcacacactgcactgctgccctgtccttggcagacattcctgtggggtcatgttcgaaatatgcacttctgtggagtagcttgggttttcttggaag

SEQ ID NO: 81107 - DNA, 201 bp, Homo sapiens
tggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaag

SEQ ID NO: 81108 - DNA, 201 bp, Homo sapiens
ctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgccca

SEQ ID NO: 81109 - DNA, 201 bp, Homo sapiens
ttagtctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctat

SEQ ID NO: 81110 - DNA, 201 bp, Homo sapiens
tctctcccggctctcttttgaaggagattggagtgcagaattggctagtctgaggtttcagtgtgcaagacgtagtcagatggctcacatttggaaccctrgtagtaatgttttattctttgtccgatggcattgggcgggttgacccagcctgcagtcaggatttccttgtaccgttcacccgggagttcagaatcgcac

SEQ ID NO: 81111 - DNA, 201 bp, Homo sapiens
ttttgtccaaagtgtatcttggacatctttctatattttattctgactgggtagtattccactgtatggatggactgcagtttaaaaattttcttgttatkggacattggctggttttccatttttttgtgattacaaataacccttcagtaacatgcttgtacacacttctttatattagagggagagttgcagtatagg

SEQ ID NO: 81112 - DNA, 201 bp, Homo sapiens
ctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattcttt

SEQ ID NO: 81113 - DNA, 201 bp, Homo sapiens
ttttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttt

SEQ ID NO: 81114 - DNA, 201 bp, Homo sapiens
ccccacctatataaaaaatacaaaaattagccgggcgtggtagtgcacgcctatagtcccagctacttgtggggctaaggctggaggatggcttgagcccwggaggtcggggcttcagtgagtggagatcgcgccactgcactccagcctgggtgatggagcaagatcctgtctccgaaaaaaaaaaaaaattggcaaaat

SEQ ID NO: 81115 - DNA, 201 bp, Homo sapiens
tcagtttgctaagatcttatgtgctagctctttagttctgaagaaagctgattgtataatgaatttaggcagtgtgtgacttgttgacaaggacagttctrtttactggctttcctatattgcaggtggacatgcaaaaggaagtcataatcacagggatccagacccaaggtgccaaacactacctgaagtcctgctata

SEQ ID NO: 81116 - DNA, 201 bp, Homo sapiens
ggttttatttttattttcttatataaaaaagagaaaaaagcaaaaatgaaaagagggaaaggaaacatgtatgatatttttgaagcccaatgatgtcattsgaggtcactttgataattaggactgtgaagctgtattgtatgtgagttaatttgtaacattatatttagataagtgaaagtttcttctagtgaggtgtgg

SEQ ID NO: 81117 - DNA, 201 bp, Homo sapiens
aaaattaatgagacttactttattactaagtctttgaaattcaatgtatattttatactcacagcatatctcagtccagtctacccatatttcaagtgctygataaccacttgtagccagtggctaccatattgaacaatgcagttatagaccatttagaaaaacatctagaatgaggtataaactaataatacatcatgt

SEQ ID NO: 81118 - DNA, 201 bp, Homo sapiens
ctgataaaacaccttgaggtcatccttgacttctgtctctcacaagccacatgcaatccatcagcaagtcttgtttgccttacctacaaaaatgtccagamtccaaccactactcatcacgttctgctacatgtgctggcccagtacactgcagtctctttcctatactgcctaatctctctgcttccattcttgtcccta

SEQ ID NO: 81119 - DNA, 201 bp, Homo sapiens; identical to SEQ ID NO: 59621

SEQ ID NO: 81120 - DNA, 201 bp, Homo sapiens
gttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtg

SEQ ID NO: 81121 - DNA, 201 bp, Homo sapiens
agttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagt

SEQ ID NO: 81122 - DNA, 201 bp, Homo sapiens
gagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataag

SEQ ID NO: 81123 - DNA, 201 bp, Homo sapiens
agagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataa

SEQ ID NO: 81124 - DNA, 201 bp, Homo sapiens
atatctattcattttcacccacaatctgggaaacagtcataaattatagtcaacagaatttaaatattaactgccagggggtaatgttaaataccagaatkgatagccagaggttttagaaatctcattctttcagtgttttttctgagcaatttatgtaaatctctattcaaatatgtaagctttatggaaaacttgaaa

SEQ ID NO: 81125 - DNA, 201 bp, Homo sapiens
ctccctctttctcagatataacagtttgtgcccatgaccacatcagctggcatctgctgggaatgagctcggggccagaattattctccattcatttcaayggccaggtcctggagcagaaccatcataaggtctcagccatcacccttgtcagtgctacatccactaccgcaaatatgactgtgggcccagagggaaagt

SEQ ID NO: 81126 - DNA, 201 bp, Homo sapiens
gataaatatgctattttaaaaaataagaatttcttcaagttgaaatcattatggttgattgcttgccctaaactctttgctatccaggaaagctaatgagygtcttctatctgcagtgctactgaaaacatgtctttcctttcatagggaccctaactgagggtgggacacagaagacgtttgacaagcaaatcgtgctac

SEQ ID NO: 81127 - DNA, 201 bp, Homo sapiens
agattagtgcccttataaaagggaccctctcactcaccctctttctaccatgtgaggatacaaggagaagatggcagtctacaacctggaagagaccctgyaccagaacccaaccatgctggcaccctgattttaaacttccagcctccagaactgtgaggaagaagtgtccgttgtttataagccactcaatccagggta

SEQ ID NO: 81128 - DNA, 201 bp, Homo sapiens
atcttaaaatgggaataataatacatacattgaaagatggtttaaggcgggggtcagtaaatttttccgtaaagggccagatagtaagtttgtttggcttygcaggccataagatctctgttgcaagtactcaactctgccttttagtacaaaagcagccatagacgatacctatttttttggctttggttacagatgcca

SEQ ID NO: 81129 - DNA, 201 bp, Homo sapiens
gcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcat

SEQ ID NO: 81130 - DNA, 201 bp, Homo sapiens; identical to SEQ ID NO: 59648

SEQ ID NO: 81131 - DNA, 201 bp, Homo sapiens
tgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctca

SEQ ID NO: 81132 - DNA, 201 bp, Homo sapiens
ttgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctc

SEQ ID NO: 81133 - DNA, 201 bp, Homo sapiens
gagtgcctattactagaatattaccaacttttagattggaaatattcaactctaagaactctgatgtgacaaaggcataatttgtagccataattgctttyattccggcccatggtctgattgcattgaaaacacatcagtcagatcaaaagcattcctgtcaattgggaaacctgtgtaaagcatccttcttcatgactt

SEQ ID NO: 81134 - DNA, 201 bp, Homo sapiens
catgaaaatctgatcgaggatttcaactcggggctgattgggcccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcat

SEQ ID NO: 81135 - DNA, 201 bp, Homo sapiens; identical to SEQ ID NO: 59650

SEQ ID NO: 81136 - DNA, 201 bp, Homo sapiens
ttcatggtataaccttgtcactccatacttcattttacaatcttttaaaaaaatttgcactctctataatttgctcttagtctttgtgatataacaagggyctcaaagataaaatgctaatttttaatggtgtcatttcaaagttagaattcgggatcagaaatatgtgttttacttaacccccttccattcacatgaaat

SEQ ID NO: 81137 - DNA, 201 bp, Homo sapiens
aaactctcagtgtgatctagaccaagaatggttctgccaatcagagtgccgacagcatctctgtgaagaaagtgcctggattatatagacacatcacaacyctccaaggaagggctctaatttggaattacctccatcagcccattttcaataagacctacctgagattcaaactaggcctgactcttccaaagtcctcag

SEQ ID NO: 81138 - DNA, 201 bp, Homo sapiens
cacatacacctatatatacacatacacttatgtatgtgtgggtgatgttgaagaaacatatcaatattatttcctttagaattgaatgaggttatggtagrcgataaatctcccaaaggtaaaaatttatcttagatgactctaaaactcagtttagaccttctgatctttctccaaacacatatcaccaaccatgtgatt

SEQ ID NO: 81139 - DNA, 201 bp, Homo sapiens
ccatttccaaaactctcctcagtcatcttttctgggtttgaccacacatgtagtatttcagccagattcacagggtcttatcagccaggcattatagtccycattaatatggccctttgcctgtggcaaccattcatctattcagaaaactttgttgaacctccactatatgtgaggaactcctccaaagttttcccacac

SEQ ID NO: 81140 - DNA, 201 bp, Homo sapiens
ctggatgaaattactagcacataaagttgggagacacctaagccaagacactggttctccttccggaatgaggccctgggaggaccttcctagccaagacwctggttctccttccagaatgaggccctggaaggaccctcctagtgatctgttactcttaaaacaaagtaactcatctaagattttggttgggagatggca

SEQ ID NO: 81141 - DNA, 201 bp, Homo sapiens; identical to SEQ ID NO: 59680

SEQ ID NO: 81142 - DNA, 201 bp, Homo sapiens
gtagaatttttagttcttttcagtgacttaggctcctaggaaaacctttgtgaaacagaggttctactcaggtaaactctcagtgtgatctagaccaagartggttctgccaatcagagtgccgacagcatctctgtgaagaaagtgcctggattatatagacacatcacaactctccaaggaagggctctaatttggaat

SEQ ID NO: 81143 - DNA, 201 bp, Homo sapiens
gaccatggcttcttcaaggacaagccctagcaggaaggatcagcaggaagattgcagtaaagatgaacagattaggagtaatcctcaacacacaaaaaaamccagcatttcaaaaggtgacagaagagtaatattcagtggcatctagaatattttctctttccatttgcatttgggcacttatgagaaggcaaaatcata

SEQ ID NO: 81144 - DNA, 201 bp, Homo sapiens
tgtatttatttacagcttactcagtaatacaaaggatctgagacagtttctcaagttataaaggcataaaacaaggagtctatgtaattgggatagaataygcggacaaagaaaataaagccacagataagtagataccatgtgaccctgtaaggctgtcttcaaattttgtcctaagctttatggcagtcagtgtaaaaa

SEQ ID NO: 81145 - DNA, 201 bp, Homo sapiens
ttaattgcaacatgactgggaaagaaaatacttaaccaaaatgtgaacatgtattcccacaggctatcagagcatttgttaggagccagaaattttacaamtattttccagtcttcataacccatcaaaaaggataaagttatctctagaaaaaggattatattatcttaaattataaatgaaaaaactgaggttaaaggg

SEQ ID NO: 81146 - DNA, 201 bp, Homo sapiens
cgttgtttataagccactcaatccagggtactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtga

SEQ ID NO: 81147 - DNA, 201 bp, Homo sapiens
ccctatcaagaaggaaatattttctctttttttttttaaacaggaaatagaagagacaaattagaagctagagaagaaatgtgcagccttgttaggtataktgacctgagtaggtttcaccttggcctgtactttgaataagaccttaaggtatcagctcagccactctctccgagttctgcagttcctctatatgatgac

SEQ ID NO: 81148 - DNA, 201 bp, Homo sapiens
gaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaa

SEQ ID NO: 81149 - DNA, 201 bp, Homo sapiens
caaattctgactcagccatcaactttttccctaactccccagacagaatttgtgcttcatcctctcttcttctgtaatattttgcccatatctcagcagtygctcctatcatacatctatctccaaactagcttgtgagttccttcagtacagggactgtatttgatccaggtagccagaaactttctaacacagtgcctg

SEQ ID NO: 81150 - DNA, 201 bp, Homo sapiens
ccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgt

SEQ ID NO: 81151 - DNA, 201 bp, Homo sapiens
atcccattatgctgatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtagg

SEQ ID NO: 81152 - DNA, 201 bp, Homo sapiens
tgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgtgatcatggctcactgcaacctccacttcctgggctcaggcgattctcgcacctca

SEQ ID NO: 81153 - DNA, 201 bp, Homo sapiens
gatggcaataatcataaagataatagtcatgcaagttattgtatcagccgctgaatagtaagtacctgatgttaatatggttctaattatcccattatgcygatgttcagatcattgtaagcatagtagagttccatcaggcactggtataaaaaattgtatccatattataatagttgttggtatgagaacattttaaaa

SEQ ID NO: 81154 - DNA, 201 bp, Homo sapiens
aaacagtacaggaaagccttattatgattatcatcaccactgcaaacaaatgctggctgaactccatgagtgccgtgacttccttctcctgcttctaggaygcctaatggcgagaagccaatcccatgacacttgtggatggctcagaaatgacagtagttgatttctgtcacttgtctggaatggggcttttggtcatag

SEQ ID NO: 81155 - DNA, 201 bp, Homo sapiens; identical to SEQ ID NO: 59718

SEQ ID NO: 81156 - DNA, 201 bp, Homo sapiens; identical to SEQ ID NO: 59719

SEQ ID NO: 81157 - DNA, 201 bp, Homo sapiens
caaccctttctctagacttcagccagacaaacctctctccagaactcagccatatgactctctctccagaactcagtcagacaaacctttccccagccctyggtcagatgcccatttctccagacctcagccatacaaccctttctctagacttcagccagacaaacctctctccagaactcagtcaaacaaacctttccc

SEQ ID NO: 81158 - DNA, 201 bp, Homo sapiens
atatttaagtcagggccacacaaggtaggtaaaaatatctaattattgagtcagaaacataatccctaaccatggagttttactttattgtatatattttrtaagcaaaaattattcattttttttctgtttttcatagactgtaggatgccaatgggactaagcactggtatcatatctgattcacagatcaaggcttca

SEQ ID NO: 81159 - DNA, 201 bp, Homo sapiens
accactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacgtggttcactttcacggccagaccttgctggaaaatggca

SEQ ID NO: 81160 - DNA, 201 bp, Homo sapiens
tgtgctgaaagaccttttttcccctctaatctccactaagcaacacttttgttttttattctgttaagcgagatgaacgcactggtcatgtgcttagagtyacagcaatgtcaaattgctttagaaaaacaaaagtttactaaatatttcattctcatttttctctccttgtgttattttgacccagtaatcaataggtca

SEQ ID NO: 81161 - DNA, 201 bp, Homo sapiens
gtgttgaatggatcatacatggcatatactgaggggtgagctccaaagaacactggggaattcaggtgggaaaataaatcaacccacgttatgtggtatcrtgtaaacaaaataactgattgttctactacacatttttgctttaaaactgttgagattagagttcatataaatggagactaaaatctaaggaaatgatat

SEQ ID NO: 81162 - DNA, 201 bp, Homo sapiens
acccactaactcgtcatctagcattaggtatatctcccaatgctatccctcccccctcctttgggagatttttaggtaatgaggatggagccctcatgatragattagtgcccttataaaagggaccctctcactcaccctctttctaccatgtgaggatacaaggagaagatggcagtctacaacctggaagagaccctg

SEQ ID NO: 81163 - DNA, 201 bp, Homo sapiens
acttacagtgcttgaatgtattaagggaaacagtacaggaaagccttattatgattatcatcaccactgcaaacaaatgctggctgaactccatgagtgcygtgacttccttctcctgcttctaggacgcctaatggcgagaagccaatcccatgacacttgtggatggctcagaaatgacagtagttgatttctgtcact

SEQ ID NO: 81164 - DNA, 201 bp, Homo sapiens
attaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcc

SEQ ID NO: 81165 - DNA, 201 bp, Homo sapiens
atagttaaagtcctgaatcttgggaaacccctcagaccagaacagtcggttaccttcttggttcccttcttggcctaatcctttagcaatccctgtgtttytgagttcacatccaccatctctaagctctgttgttacctgtataatgccatttatcacaatgagttgtcactgcttgtttgctggtcactcagatgtctg

SEQ ID NO: 81166 - DNA, 201 bp, Homo sapiens
acaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaa

SEQ ID NO: 81167 - DNA, 201 bp, Homo sapiens
gaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaag

SEQ ID NO: 81168 - DNA, 201 bp, Homo sapiens
tcatctcaagattcttaatcatagatacacagtcccttttgccatataaagtagcatatttccaggtcccagagattaggacgtggacatctcagcagggrcacattattctgcctactacacccaccaaacaaagccctcccacggtgtcctccatctcagagaatggcaccctcctccacccagctccccaaatcagaa

SEQ ID NO: 81169 - DNA, 201 bp, Homo sapiens
tcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacgtggacatctcagcaggggcacattattctgcctacta

SEQ ID NO: 81170 - DNA, 201 bp, Homo sapiens
agaccacagagaaatcaaattagaactgaggactaagaaactcactcgaaaccacacaactacatggaaactgaacaacctgctcctgaatgactactggrtaaataatgaaattaaggcagaaataaataagttccttaaaaccaatgagaacaaagagacaacataccagaatctctaggagacagggctttgcttttg

SEQ ID NO: 81171 - DNA, 201 bp, Homo sapiens
aaacacagatataattgttggttcaaattattcttccccaagtaatattagtaagttcactgtcaataaccttgcagaacctcagaaagccccttctcacyaacaagccaccacagctggttccccactgagacacctcattggcaagaactcagttctcaattcttccacagcagagcattccagcccatattctgaaga

SEQ ID NO: 81172 - DNA, 201 bp, Homo sapiens
attagacatgagatgcttctgagacacccagagctacaactaaaaccggttccttaacattccagagggctgatgtaatctggcaggtgacactgtgggtraggcaaaaagagaaagtctgaaagatagcacagagaagctgctgcaaaacaaaccaacagaaaaccacaacaacaaaaagccagtgtgcttcagctggta

SEQ ID NO: 81173 - DNA, 201 bp, Homo sapiens
cttaaggttctcccaggcaaattcctgtttgagagtatgttctgatgtcatgcttgtatgatctgtaacatttacctcaaggccaaagtcttttagaaagyatacagtagcctatactctgctgaaagagctcttggaaagaactttggctaacatgtttgacatatctgaggtttgggctggtaatttgctctataaaca

SEQ ID NO: 81174 - DNA, 201 bp, Homo sapiens
tccacctgcttcagcctcccaaagtgctggggttacaggtttgagccactgaacctagctgagaagatgacttcaaagacagtgtcctaaaaaatctaccrggcaggggaaggggatcatggtctagagatgagaagcagattcaaaatgagatgtggcccaagctgaaaagagaagggcaggggaaggaggacttgcttg

SEQ ID NO: 81175 - DNA, 201 bp, Homo sapiens
ctgcccacatgtcttgatggctgttactcctccaggtgcttcttaccttgaccacacattccctgcggagaagatggacgacgctgtggctccaggccgakaatacacctatgaatggagtatcagtgaggacagtggacccacccatgatgaccctccatgcctcacacacatctattactcccatgaaaatctgatcga

SEQ ID NO: 81176 - DNA, 201 bp, Homo sapiens
aaaccatatttcaaaacactaaacttcttagaggttattctctaatgccatctgaaaatcacaaatagcttcacttactaaaacacaaatattgttaagakttgagatctgggtagtgtttttaaattgtattctatttcatttgactacattttccacttggttttctgaaaatatactcatatgactctcaatgttgat

SEQ ID NO: 81177 - DNA, 201 bp, Homo sapiens
gcagaggaaactgttcattccacttggctctctatggcactcacctctccccttcctgacctcacttgctccattttattattgaaaacctcacccaaccytctacacttcttttaatattgagtatctcagttccttctcttcaataaagaagaccaatttcttcatcctctccctctcctatcagtagggaaagtccaa

SEQ ID NO: 81178 - DNA, 201 bp, Homo sapiens
tagcagtagtctaaaacatctcccaaataaaacacagatcttgtatcggcaggaccactccttgaaacagttccataagtcattgcgtttttttctttccrtatggtataaatagatttgttcagatcctaataaactaccctaaaatgtgacattcaattctgctaacttatttaaaacatctattttttatacaagaag

SEQ ID NO: 81179 - DNA, 201 bp, Homo sapiens
ctattgtagtttgttttgttctttatttcagtgtacctgaagtaaatagtagtgttaatgctagtaagcctctgaggcagtgtgattctcagactttttgkggggccatgcctgaggaatgacattctccttctggttcttccaggggctcagccataagccctaactcttctcctcctctctattcccttccccaaagaa

SEQ ID NO: 81180 - DNA, 201 bp, Homo sapiens
gttagttcttgtaattgtagggggctgggctgtaggattggaggtatgaagatgcccatccaataaggtttgtggacatttgggcaggtgagggagtacasctggggtcatttttaggaattctgtcttgggctttaaaatggctagtcttggctgggcatagtggctcatgactgtaatcccagcactttgggaggccaa

SEQ ID NO: 81181 - DNA, 201 bp, Homo sapiens
ggaaaaaccgatagctgggggtcattgatttctctacataaaaagcccagcctctctgcagggatttggcaaggatcagataccttagtcttatgaccacrcgcccatttccaaaactctcctcagtcatcttttctgggtttgaccacacatgtagtatttcagccagattcacagggtcttatcagccaggcattatag

SEQ ID NO: 81182 - DNA, 201 bp, Homo sapiens
taaataaccctagaaccattattacttgataaatatgctattttaaaaaataagaatttcttcaagttgaaatcattatggttgattgcttgccctaaacwctttgctatccaggaaagctaatgagcgtcttctatctgcagtgctactgaaaacatgtctttcctttcatagggaccctaactgagggtgggacacaga

SEQ ID NO: 81183 - DNA, 201 bp, Homo sapiens
gacaataactgtactgtgtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaa

SEQ ID NO: 81184 - DNA, 201 bp, Homo sapiens
atatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaag

SEQ ID NO: 81185 - DNA, 201 bp, Homo sapiens
cttctcttgagttatttcattgtctttctgtcctaactcagctgggatgcaggcttacattgacattaaaaactgcccaaagaaaaccaggaatcttaagwaaataactcgtgagcagaggcggcacatgaagaggtgggaatacttcattgctgcagaggaagtcatttgggactatgcacctgtaataccagcgaatat

SEQ ID NO: 81186 - DNA, 201 bp, Homo sapiens
gagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgcct

SEQ ID NO: 81187 - DNA, 201 bp, Homo sapiens
ttaatgtaggtgattacattttttcacttctcatctgaatattttggccttatgtagagacttccttgagtatatgataaacacctgaaacaaactataayggctatagtttgtatatttaataaatcacaaaaatgtggatcccttttccaaagagacttgcaagtcctgtgcaatgaaatcagctctttataaaacgtc

SEQ ID NO: 81188 - DNA, 201 bp, Homo sapiens
ctctgggtgaggtagtgggaacaggagtttctcctatgttcttaaaatcatacagtgacatagtgaacaaccacttcacctacttatgaggcttctagacractgcatcagaagttcagcaatgtaaagaagaagggggagaaacctcaaaatatcaaaatgtcacatgcaggtttcatttcaaataagggaggaggtaag

SEQ ID NO: 81189 - DNA, 201 bp, Homo sapiens
accccacaaaactttaaaaaatcattttatcatcaaacaaaatacccagatttctcagactggccaatggtatacggcagagtagaacatctggtcttgcrcctcaaggagctcatgctaaaaattggctaccaagacttttgattttactattgtagtttgttttgttctttatttcagtgtacctgaagtaaatagtag

SEQ ID NO: 81190 - DNA, 201 bp, Homo sapiens
agagtcttttccaggaaaaaccgatagctgggggtcattgatttctctacataaaaagcccagcctctctgcagggatttggcaaggatcagataccttastcttatgaccacgcgcccatttccaaaactctcctcagtcatcttttctgggtttgaccacacatgtagtatttcagccagattcacagggtcttatcag

SEQ ID NO: 81191 - DNA, 201 bp, Homo sapiens
tgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactatggtaggagctaaaggcctgttagtgtgctcttaacactgcca

SEQ ID NO: 81192 - DNA, 201 bp, Homo sapiens
agcctgagaaccctagttatctaatctgagaagtgggcagaggagttgtcataccaataagagaataaacatgacttgctatggttgctggatacaccaaygataaactcctaattttataaactcctagacttcctaatttgcctgaaactttctctgaatttagaaggccttaaggtgacatgctgcatatctccttgc

SEQ ID NO: 81193 - DNA, 201 bp, Homo sapiens
ttcacaaggaaaatttgccctgtaagctagtaactgaaacagaaactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaactta

SEQ ID NO: 81194 - DNA, 201 bp, Homo sapiens
ctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttatta

SEQ ID NO: 81195 - DNA, 201 bp, Homo sapiens
gggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctc

SEQ ID NO: 81196 - DNA, 201 bp, Homo sapiens
tccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattct

SEQ ID NO: 81197 - DNA, 201 bp, Homo sapiens
acgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacagggtacactact

SEQ ID NO: 81198 - DNA, 201 bp, Homo sapiens
cacaattcttctttatattttctttcataccctgtgtaggtactcaagtcttttctatgttagctgctatttctcaggggctgtaatgtgacctgtggtayaaataaatccaggtaatcataaatggtcataataaaattctactatatatagcaaggatgtttaagagtcttaactgttcttcttggactcttaaagcag

SEQ ID NO: 81199 - DNA, 201 bp, Homo sapiens
aaatatcctgggattattcagaatttgtacaaaggtttggccagttttctccttttttattctcatttttccattactgctgaaaaaagtagctactacarttcagggggataattgtgggcaaattatactaagaacagtgtggttcccctattgcaagttggcctgttctttttcctttgtcaattccaagattgcttc

SEQ ID NO: 81200 - DNA, 201 bp, Homo sapiens
tggcatttggcttctgagaaaggtagctatgaaataatccaagatactgatgaagacacagctgttaacaattggctgatcagcccccagaatgcctcacktgcttggggagaaagcacccctcttgccaacaagcctggaaagcagagtggccacccaaagtttcctagagttagacataaatctctacaagtaagacag

SEQ ID NO: 81201 - DNA, 201 bp, Homo sapiens
ctgtccagtggcacttctgtagtgtggggacccagaatgaaattttgaccatccacttcactgggcactcattcatctatggaaagaggcatgaggacacyttgaccctcttccccatgcgtggagaatctgtgacggtcacaatggataatgttggtgagtaagagtctggacactcacagaggaagcttgctttgaatt

SEQ ID NO: 81202 - DNA, 201 bp, Homo sapiens
atgaaaagaagagctggtactatgaaaagaagtcccgaagttcttggagactcacatcctcagaaatgaaaaaatcccatgagtttcacggtattttcctyggactttgatctaatctcctaattaaatcacactgggtcacagtgatttctgcccttagatattcacaagattagacatgagatgcttctgagacaccca

SEQ ID NO: 81203 - DNA, 201 bp, Homo sapiens
agtcacagcaatgtcaaattgctttagaaaaacaaaagtttactaaatatttcattctcatttttctctccttgtgttattttgacccagtaatcaatagktcacagacaagcagtggtccacagcccatacttgaatattcctgacgaaagtttattagaaattacctgccacaatggattattgtgttttcatgtcttt

SEQ ID NO: 81204 - DNA, 201 bp, Homo sapiens
tgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctatggacatgagagaatttgtcttactatttatgacctttgatgaaaagaagagctg

SEQ ID NO: 81205 - DNA, 201 bp, Homo sapiens
agatgaacgcactggtcatgtgcttagagtcacagcaatgtcaaattgctttagaaaaacaaaagtttactaaatatttcattctcatttttctctccttrtgttattttgacccagtaatcaataggtcacagacaagcagtggtccacagcccatacttgaatattcctgacgaaagtttattagaaattacctgccac

SEQ ID NO: 81206 - DNA, 201 bp, Homo sapiens
cacaatatttacttgttaatttttgcaaatgtaatgttgttctttttattttaggttcatttaaaactcttgaaatgaaggcatcaaaacctggctggtgrctcctaaacacagaggttggagaaaaccagagagcagggatgcaaacgccatttcttatcatggacagaggtatcacaagagccatgtgatatttggttt

SEQ ID NO: 81207 - DNA, 201 bp, Homo sapiens; identical to SEQ ID NO: 59790

SEQ ID NO: 81208 - DNA, 201 bp, Homo sapiens
ttgtatgtgagttaatttgtaacattatatttagataagtgaaagtttcttctagtgaggtgtggtggtgatttaaaattttttttagttatctctgtgtrtgtgttgttattgttttgtttttatctgttatactttcagtcctacctaaagaaaaatggttaaattctatttgaaagcctcttgtgaagcaggaatttt

SEQ ID NO: 81209 - DNA, 201 bp, Homo sapiens
gatcattccttttcctaggttcgttttaaaaatttagcatccagaccgtattctctacatgcccatggactttcctatgaaaaatcatcagagggaaagasttatgaagatgactctcctgaatggtttaaggaagataatgctgttcagccaaatagcagttatacctacgtatggcatgccactgagcgatcagggcca

SEQ ID NO: 81210 - DNA, 201 bp, Homo sapiens
caatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaata

SEQ ID NO: 81211 - DNA, 201 bp, Homo sapiens; identical to SEQ ID NO: 59791

SEQ ID NO: 81212 - DNA, 201 bp, Homo sapiens
tggccacccaaagtttcctagagttagacataaatctctacaagtaagacaggatggaggaaagagtagactgaagaaaagccagtttctcattaagacaygaaaaaagaaaaaagagaagcacacacaccatgctcctttatctccgaggacctttcaccctctaagaagtgaagcctacaacacattttcagaaagaag

SEQ ID NO: 81213 - DNA, 201 bp, Homo sapiens
aaaactacttgggccatatctcacaggatggttatgaaaattaaatgaaataatatacataagttattttgtaccttatatcttagctccgattttataaycagccattttgacttataatgctgacatttttgtggtttagatttttgttaagcttaagtacatttgtggatcattccttttcctaggttcgttttaaaa

SEQ ID NO: 81214 - DNA, 201 bp, Homo sapiens
ttagatttttgttaagcttaagtacatttgtggatcattccttttcctaggttcgttttaaaaatttagcatccagaccgtattctctacatgcccatggrctttcctatgaaaaatcatcagagggaaagacttatgaagatgactctcctgaatggtttaaggaagataatgctgttcagccaaatagcagttatacct

SEQ ID NO: 81215 - DNA, 201 bp, Homo sapiens
tagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatctcagtc

SEQ ID NO: 81216 - DNA, 201 bp, Homo sapiens; identical to SEQ ID NO: 59792

SEQ ID NO: 81217 - DNA, 201 bp, Homo sapiens
agacaattctccttaaatgtcatgtcacttcaccaagatagataagaattggacagcagagaattaaaggttgcaatctttgacaaaatcctagagtgtarttaatctacagacaaaggatgatccaaaggctttgacaatcaaccaaatagaagataggattaaggttctcttttgcagattaaagagcctaactaggac

SEQ ID NO: 81218 - DNA, 201 bp, Homo sapiens
ttctattttgccttctattaaaagtaatggcaaaaaccgcaattatagtttgcaccaacctaacacatgctgcctgaggagttagtgaaggcagcccctcracagcactttgggtgacgttgtgtgaatctgcctcagatgcagacacagaagtccaaatggactggtttgattaagagcagggaaaaaaagagggttctt

SEQ ID NO: 81219 - DNA, 201 bp, Homo sapiens
actctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagat

SEQ ID NO: 81220 - DNA, 201 bp, Homo sapiens
ctgccaagtgggggtcaaagtccaggttccccactccattgccacctaagaagggattgttccttggtggctgggtgggaagggaagttccccatttggcmtccactgatactgcaggggcaggagcttcattaggggctggagatgaaagccctaaatccctacatggccttttctgacacaaccccagtgagggtgtag

SEQ ID NO: 81221 - DNA, 201 bp, Homo sapiens; identical to SEQ ID NO: 59793

SEQ ID NO: 81222 - DNA, 201 bp, Homo sapiens
cattaatgggatgatctacagcttgcctggcctgaaaatgtatgagcaagagtgggtgaggttacacctgctgaacataggcggctcccaagacattcacrtggttcactttcacggccagaccttgctggaaaatggcaataaacagcaccagttaggggtctggccccttctgcctggtaaagattgggtaatgggaag

SEQ ID NO: 81223 - DNA, 201 bp, Homo sapiens
cagagttactttgaccattaaaatagtaatatgcgccaagtgcctagcactcagtagacaccaacaatggtaactattggagactcaccaagaaatctttratgttccagcaatgcatgccatttcagagattcaaaattgtcctcgtgaattattacttagaaacatctaaatgtctcttatttgtggggatagagctca

SEQ ID NO: 81224 - DNA, 201 bp, Homo sapiens
ttctgagtaatttagtttgatcaattagacagacattaatttgtgtgactagagtaacctttcattatctatctcaaaatatcatgtacacaagtatatayaataattttttaagcccagtatgtgttaaaataaatctaggtgtgaaacattgattgtttacagataggttcaatattgttagaaaatcagtcaccctgc

SEQ ID NO: 81225 - DNA, 201 bp, Homo sapiens
tacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttgatgttccagcaatgcatgccatttcagagattc

SEQ ID NO: 81226 - DNA, 201 bp, Homo sapiens
taacggctatagtttgtatatttaataaatcacaaaaatgtggatcccttttccaaagagacttgcaagtcctgtgcaatgaaatcagctctttataaaaygtcagcattgattcgcccattgcctacattatagcttctaaaagaatattctgaatctttgaatgtagtgaagcattcactaagtttattaacttaggag

SEQ ID NO: 81227 - DNA, 201 bp, Homo sapiens
agtcacttaagtgatttaagtaggtatttaaatatttgttaatgccagtcattatactggtactaaggctaagagtggtaatcgaggtagacatgagcccygcccttgtagaaatcatacctttggttttttactatgcttagtacataagtaaataaaaatattgcctacagcagtgtcccttttaacaataatgaaatg

SEQ ID NO: 81228 - DNA, 201 bp, Homo sapiens
ttgaggaaaaacaatgaagcattaactgtggcactgagatttcttccaaagtgaatttggcaagactctgggtgaggtagtgggaacaggagtttctcctwtgttcttaaaatcatacagtgacatagtgaacaaccacttcacctacttatgaggcttctagacgactgcatcagaagttcagcaatgtaaagaagaagg

SEQ ID NO: 81229 - DNA, 201 bp, Homo sapiens
agagaagccaccatgattcacaatggagaaagtagctgaaacctggaatcagtttcctgttgaagcagataatggcacagtatacccttggatggatatgrgtattttgccaatgtccagatagcagtagtctaaaacatctcccaaataaaacacagatcttgtatcggcaggaccactccttgaaacagttccataagt

SEQ ID NO: 81230 - DNA, 201 bp, Homo sapiens
catcatgtaaattattaaagtcacttaagtgatttaagtaggtatttaaatatttgttaatgccagtcattatactggtactaaggctaagagtggtaatsgaggtagacatgagccctgcccttgtagaaatcatacctttggttttttactatgcttagtacataagtaaataaaaatattgcctacagcagtgtccct

SEQ ID NO: 81231 - DNA, 201 bp, Homo sapiens
acttttattttagattcagggggcatatgtgcagttttgttatctgggtatattatgtgatgctgttgtttagggtatgattgatcccatcatccaagtarcgtgcatagtacccaatagtttttcatcccttgctcatctccttccttcccccttctagaagtccccagtgtttattgccatctttatgttcatgagtac

SEQ ID NO: 81232 - DNA, 201 bp, Homo sapiens
ccaaagatggattgacacatcaaagtagagcaaaatgagtatagggacccaagagtcttggaaaggcatgcatgaagacatttcaagtgatcagtaagatkttcagaacaaaaggaattccctgaatgagggttccggcatttgctgcagttctaaagttcagtggccaaaagcactgccatggcagtctgagagaaatgt

SEQ ID NO: 81233 - DNA, 201 bp, Homo sapiens
caatgactaatatatcaaaaagatgaatttcttatattatgcttttcctccaagtggaattattagaatatctttaaaggcagagaatggagcacaaaatmtttactatacatttgacgaatgactaaatcaatgtaaatggaaggctttatctttttcctgagatttctcctttggctaatttaggagaataatctctca

SEQ ID NO: 81234 - DNA, 201 bp, Homo sapiens
tcatagcaacatttttaagcaagaggtcaaaggctcacatccttagaaatgcgtttgatcttctattccaagcgtgtgtgtgtgtgtgtgtgtgtgtgtgkacacagacatactctgcgtggtgaggaaaagggtgagagagtaggactaatggaaggtgttatagtccatgtcaatagtatcctagactgagttcagggt

SEQ ID NO: 81235 - DNA, 201 bp, Homo sapiens
aaaaagaaagcaccatttatcctgatgttaagatctaagaggaacttctttaatgagttctacaaaagagagtgctgagtgatacagtagatggcatcctkgataaaattcttataaccagcataatagattaaaagttgcataaaataatagattaaaagttgcattaaaatatttctcattatagctaagatataacag

SEQ ID NO: 81236 - DNA, 201 bp, Homo sapiens
ttaaggctgcttaaaaaaaataaaaaatactactagatgacatatgttagaagtagggaagaaagcaaaaccggaggtagaaacataaacaggaagcagaraaaagctaacaggaaaatgcatatcataaagctatcgaccttgctatgggtgaacttgggtttaagtgaactttttaaacagccaatgcacaaaaaaacc

SEQ ID NO: 81237 - DNA, 201 bp, Homo sapiens
agaatataaatatgcatacacagaacttctgtagatgaatacaattgttgacatgaaaagtaaaaaataaagcatagaaaagaaaggtaaaaaataaaggwtaaaaaaatatattataaactgaaggataccactaatacaacaaacactggatgaaattaatagcacattagacactgtgaaaggaaatagtagaaaata

SEQ ID NO: 81238 - DNA, 201 bp, Homo sapiens
atcaccaccatccactgctcattactttttattgcagctctattttctacccatacttgatgctcttcccagtaggtggcatgtctggttcaactgtactyagccagagttctgaagacattcacatagaggtcaagctttaattattcaggctaaacaaataattgaacagcttgcatggacttttttcagtgggtttaa

SEQ ID NO: 81239 - DNA, 201 bp, Homo sapiens
aaaaaaatctccccttgaccctgcctgccttttccttttctctcctttccttcactaccagttttctgtatgagaactctgtatcattctctacatttctkcgcctatattccttccctaatctgctttagtatgaataagtctactaaaattactctcacaaaagggcacctaggacttgaggtgccagagcctatgttc

SEQ ID NO: 81240 - DNA, 201 bp, Homo sapiens
ggatacaccaacgataaactcctaattttataaactcctagacttcctaatttgcctgaaactttctctgaatttagaaggccttaaggtgacatgctgcmtatctccttgctgactctaatccctggagtttactttgtctgcccatatttgtatttatcttttgtagttaaggaaaattaagactgttaatggaaagta

SEQ ID NO: 81241 - DNA, 201 bp, Homo sapiens
ggcttaagccaaaggtagattttacagcctctaaaaatcattttccttcaggcaaaggctcatatcataaatactgtttctctaaggcatgattttgttakctactctgtgacaatgagctcaagattgtgtattctgcaaggtgtaacaactgcatttttacaaaattgttatgttcttgcacaagattctatcataagc

SEQ ID NO: 81242 - DNA, 201 bp, Homo sapiens
tgcaatttaaagttaataagcttgtttctggatctctaaaggcacaagtgtttatataaaagaaatgatcacctgtgtgtcttttctaaaataagaatgaygctaacagttttagctctcagcagctaccaggtggcacccaaagcatatgagaacaaaatgagataagaaactaggtacccaggtaataggagaatagtg

SEQ ID NO: 81243 - DNA, 201 bp, Homo sapiens
tcttgattcatccctttcttaatatattttaaaatagtgagcaactatctgtgctgaaagaccttttttcccctctaatctccactaagcaacacttttgktttttattctgttaagcgagatgaacgcactggtcatgtgcttagagtcacagcaatgtcaaattgctttagaaaaacaaaagtttactaaatatttcat

SEQ ID NO: 81244 - DNA, 201 bp, Homo sapiens
gtcctccaggtctttatcagacagtgcccccagaggaacactatcaaacattccccattcaagaccctgatcaaatgcactctacttcagaccccagtcasagatcctcttctccagagctcagtgaaatgcttgagtatgaccgaagtcacaagtccttccccacagatataagtcaaatgtccccttcctcagaacatg

SEQ ID NO: 81245 - DNA, 201 bp, Homo sapiens; identical to SEQ ID NO: 59804

SEQ ID NO: 81246 - DNA, 201 bp, Homo sapiens
ctgtagatgaatacaattgttgacatgaaaagtaaaaaataaagcatagaaaagaaaggtaaaaaataaaggataaaaaaatatattataaactgaaggayaccactaatacaacaaacactggatgaaattaatagcacattagacactgtgaaaggaaatagtagaaaatattaatacattgcaatagaaactgcaaag

SEQ ID NO: 81247 - DNA, 201 bp, Homo sapiens
ataaatttctatgggtaatttggcattcacatgcatctaaaatatccatttactgaaaatttatagaaacgtgtggttttttttttaagaagtactggctrcataatatgtggggcccagtgcaaaatgaaaatgtgagtccccttgttcatattattgaaaatttcacagtgactgcaaagcattaaaccaagccagggg

SEQ ID NO: 81248 - DNA, 201 bp, Homo sapiens
ccatctggctgttggaggagctaaagagcagcttgaaaaccatttagccatgtgttttcctacatgcgtgaaagtatttggtatgcatttatgaaaacatmcttttgttttgccttaaatctgaagaagcaggaggggaggttgaataaatactccaaactgtccactgaagtaataggtcttattaggttaaataactta

SEQ ID NO: 81249 - DNA, 201 bp, Homo sapiens
gaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatc

SEQ ID NO: 81250 - DNA, 201 bp, Homo sapiens
aaattattcttccccaagtaatattagtaagttcactgtcaataaccttgcagaacctcagaaagccccttctcaccaacaagccaccacagctggttccycactgagacacctcattggcaagaactcagttctcaattcttccacagcagagcattccagcccatattctgaagaccctatagaggatcctctacagcc

SEQ ID NO: 81251 - DNA, 201 bp, Homo sapiens
agtggcacttctgtagtgtggggacccagaatgaaattttgaccatccacttcactgggcactcattcatctatggaaagaggcatgaggacaccttgacmctcttccccatgcgtggagaatctgtgacggtcacaatggataatgttggtgagtaagagtctggacactcacagaggaagcttgctttgaatttctggt

SEQ ID NO: 81252 - DNA, 201 bp, Homo sapiens
ttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaata

SEQ ID NO: 81253 - DNA, 201 bp, Homo sapiens
atccttagaaatgcgtttgatcttctattccaagcgtgtgtgtgtgtgtgtgtgtgtgtgtgtacacagacatactctgcgtggtgaggaaaagggtgagrgagtaggactaatggaaggtgttatagtccatgtcaatagtatcctagactgagttcagggtgaatatatggctaggacagaaagaaggcaagtaatcca

SEQ ID NO: 81254 - DNA, 201 bp, Homo sapiens
cagcagacatcgaacagcaggctgtgtttgctgtgtttgatgagaacaaaagctggtaccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaata

SEQ ID NO: 81255 - DNA, 201 bp, Homo sapiens
tatttatttacagcttactcagtaatacaaaggatctgagacagtttctcaagttataaaggcataaaacaaggagtctatgtaattgggatagaatatgsggacaaagaaaataaagccacagataagtagataccatgtgaccctgtaaggctgtcttcaaattttgtcctaagctttatggcagtcagtgtaaaaaag

SEQ ID NO: 81256 - DNA, 201 bp, Homo sapiens
tttggaaatattatagaagacgcccatgaggaacaggattctgacttgcttagggtgataggagaatgacactggagtggggagaagacgggtaaaagtaygttgtatgtgagaaattgactaatggagagatgagacaatcattgaggatgtttggacaatgacaagagttcaaagttcttatgcgatggttttattttt

SEQ ID NO: 81257 - DNA, 201 bp, Homo sapiens
cacagatcagatagttgtaggtgcgcagccttatttctgagttctctattctgttccattggtctatgcgtctgttcttgtaccagtactatactgttttktcctccagagggcagcagacatcgaacagcaggctgtgtttgctgtgtttgatgagaacaaaagctggtaccttgaggacaacatcaacaagttttgtga

SEQ ID NO: 81258 - DNA, 201 bp, Homo sapiens
agcatgtgaatttttgtgtatacacatatatacacatacacctatatatacacatacacttatgtatgtgtgggtgatgttgaagaaacatatcaatattwtttcctttagaattgaatgaggttatggtagacgataaatctcccaaaggtaaaaatttatcttagatgactctaaaactcagtttagaccttctgatct

SEQ ID NO: 81259 - DNA, 201 bp, Homo sapiens
ctgtgttaccttagacaagttactgtgttttggctgtactaaaatggagatatttatgagcattatataatacatgtaaagcctgagaacagtatttggcmcttggattcaataaatcttcattgttgtggttattgtttttgtcatttgttggtagtaatattatttcttatctcctctgcagtgcatgaagccatgcag

SEQ ID NO: 81260 - DNA, 201 bp, Homo sapiens
gatcagcaggaagattgcagtaaagatgaacagattaggagtaatcctcaacacacaaaaaaaaccagcatttcaaaaggtgacagaagagtaatattcartggcatctagaatattttctctttccatttgcatttgggcacttatgagaaggcaaaatcatagcaatcgttaagagaaaaaataactaattcccactta

SEQ ID NO: 81261 - DNA, 201 bp, Homo sapiens
gttcttttcagtgacttaggctcctaggaaaacctttgtgaaacagaggttctactcaggtaaactctcagtgtgatctagaccaagaatggttctgccartcagagtgccgacagcatctctgtgaagaaagtgcctggattatatagacacatcacaactctccaaggaagggctctaatttggaattacctccatcag

SEQ ID NO: 81262 - DNA, 201 bp, Homo sapiens
agaatccagcccatctttcattaaaacaaacaaccacagtgagccacagcatgggaaataacgtgatggactcaccatctgcctatacatacacgctcagrccatacctacatacatgcccaatgtatttactcattatacaaagactttttttccatttcctggtatatataagatactgtgatggtactgaaaaaaacc

SEQ ID NO: 81263 - DNA, 201 bp, Homo sapiens
ctttttctgacattgctctgtcaggaaaaggggtagggcacagcctgtttactgccaagtgggggtcaaagtccaggttccccactccattgccacctaaraagggattgttccttggtggctgggtgggaagggaagttccccatttggcctccactgatactgcaggggcaggagcttcattaggggctggagatgaaa

SEQ ID NO: 81264 - DNA, 201 bp, Homo sapiens
gcaggagtatcgcttgaatccggaaggcagaggttgcagtgagccgagatcacgccactgcactccagcctggtgacggagtgagactccgtctcaaaaamaaaaaaaaaaaaaaaatcttttcacagaaccagccttgttttattgatttttctctattgtttttctgttttcagtattaccgatacctgctccaatctt

SEQ ID NO: 81265 - DNA, 201 bp, Homo sapiens
tttatcccatgagaatccagcccatctttcattaaaacaaacaaccacagtgagccacagcatgggaaataacgtgatggactcaccatctgcctatacayacacgctcaggccatacctacatacatgcccaatgtatttactcattatacaaagactttttttccatttcctggtatatataagatactgtgatggtac

SEQ ID NO: 81266 - DNA, 201 bp, Homo sapiens
tttaaattacagatcctatgttctaaatagttacagggctattaaaattatctatgtcatattgggtgaattgaaatactttgtatatttcaattaactgstcaattccctctacgttgttaagtttatatgtgtagagttgtttgtatattcccttatcctttttcatgtttgtagtgattttgcctgtttcatctctga

SEQ ID NO: 81267 - DNA, 201 bp, Homo sapiens
ctatcagtagggaaagtccaatatacatggaggtgttaatgatgtgtctttgggtgcacaaagtacaaagtaagacatctaagtttcaggggatggacacrtttcatattcatacagacaaccagcctgcataggggagttagacgctgtggctcgggggaaaaaattgagataatcagatggctaagatgaaataaagag

SEQ ID NO: 81268 - DNA, 201 bp, Homo sapiens
tctgttatactttcagtcctacctaaagaaaaatggttaaattctatttgaaagcctcttgtgaagcaggaattttaggattcttagagaactatcaaccmcaatatttacttgttaatttttgcaaatgtaatgttgttctttttattttaggttcatttaaaactcttgaaatgaaggcatcaaaacctggctggtggc

SEQ ID NO: 81269 - DNA, 201 bp, Homo sapiens
ctttacaagaacttttattggctgggcttcttaggagcaagcttggattttcattttatcccatgagaatccagcccatctttcattaaaacaaacaaccrcagtgagccacagcatgggaaataacgtgatggactcaccatctgcctatacatacacgctcaggccatacctacatacatgcccaatgtatttactcat

SEQ ID NO: 81270 - DNA, 201 bp, Homo sapiens
gcatctcttctttcttgacttttcaatcatcgccattctgactggcatgagagggcatctcattgcgtttttctttctttttttgagacggagtctcgctstgtcgcccaggctggagtgcagtggcgcaatctctgctcactgcaagctccgcctcccaggctcacgccattctcctgcctcagcctcccgagtagctga

SEQ ID NO: 81271 - DNA, 201 bp, Homo sapiens
aaaaaatctccccttgaccctgcctgccttttccttttctctcctttccttcactaccagttttctgtatgagaactctgtatcattctctacatttcttmgcctatattccttccctaatctgctttagtatgaataagtctactaaaattactctcacaaaagggcacctaggacttgaggtgccagagcctatgttct

SEQ ID NO: 81272 - DNA, 201 bp, Homo sapiens
ttgcgtttttctttctttttttgagacggagtctcgctctgtcgcccaggctggagtgcagtggcgcaatctctgctcactgcaagctccgcctcccaggytcacgccattctcctgcctcagcctcccgagtagctgagactacaggggcccgccaacacaaatacaaaatacaaaaaatataattttttgtatttttag

SEQ ID NO: 81273 - DNA, 201 bp, Homo sapiens
tattttgtacatttgtacattttattttgtataattgattttgtacattaatcttgcatcctgaaactttactgaagtcatttatcagttcctggagcctyttcatggagtctttagggttttctaggtacagaatcatattgccaatgaagagagatactttaacttcttttcttctttggttgccttttatttctttct

SEQ ID NO: 81274 - DNA, 201 bp, Homo sapiens
gcgtattttactgtggggagagtagataaagcctgagaaccctagttatctaatctgagaagtgggcagaggagttgtcataccaataagagaataaacaygacttgctatggttgctggatacaccaacgataaactcctaattttataaactcctagacttcctaatttgcctgaaactttctctgaatttagaaggcc

SEQ ID NO: 81275 - DNA, 201 bp, Homo sapiens
aagaaggaaatattttctctttttttttttaaacaggaaatagaagagacaaattagaagctagagaagaaatgtgcagccttgttaggtatagtgacctragtaggtttcaccttggcctgtactttgaataagaccttaaggtatcagctcagccactctctccgagttctgcagttcctctatatgatgaccatggct

SEQ ID NO: 81276 - DNA, 201 bp, Homo sapiens
ttaacaagaccatactacagtgacgtggacatcatgagagacatcgcctctgggctaataggactacttctaatctgtaagagcagatccctggacaggcraggaatacaggtattttgtccttgaagtaacctttcagaaattctgagaatttcttctggctagaacatgttaggtctcctggctaaataatggggcatt

SEQ ID NO: 81277 - DNA, 201 bp, Homo sapiens
acctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggcgaggaatacaggtattttgtccttgaagtaacctttca

SEQ ID NO: 81278 - DNA, 201 bp, Homo sapiens
tatctaatggctacatgttatccaggttccaagtagaatatttaaagaattcaattgaacaatgagaacatttagacacaggatggggaacatcacacacyggggcctgtcggggggggggggtggggggcggggggagggatagcattaggagatatacctaatgttaatgacaagttaatgggtgcagcacaccaacat

SEQ ID NO: 81279 - DNA, 201 bp, Homo sapiens
ttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtgg

SEQ ID NO: 81280 - DNA, 201 bp, Homo sapiens
ggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagaggagttttattggccttttaccccatcatgtaaaacatttcaggcttttttc

SEQ ID NO: 81281 - DNA, 201 bp, Homo sapiens
atccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgtttt

SEQ ID NO: 81282 - DNA, 201 bp, Homo sapiens
gacttgtcattaaaacaatcaaaaagtaagtaaaaataacaattgaaaatcctcacatcatcttcacatcttcttcccttaggcagagcttcgaccactasagctagagagctgagaggattaagtgcttgaactcagccctattggcggttctggtgatttgactccctccagctgagatcagactggggtgaccaaaca

SEQ ID NO: 81283 - DNA, 201 bp, Homo sapiens
atataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagct

SEQ ID NO: 81284 - DNA, 201 bp, Homo sapiens
cttttgttgaaatgcttttgaggaattagtcataaattctttcccaaggctgatatccagaatggtgtttcctaggtttttcttctaggattcttatagtktgaggtctgacatttaaatctttaatccattttgagttaatttttgtatatgatgaatccagtttcattggattcattggggttcagtttcattcttcca

SEQ ID NO: 81285 - DNA, 201 bp, Homo sapiens
acactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactagagctagagagctgagaggattaagtgcttgaactcagccctattggcggttctgg

SEQ ID NO: 81286 - DNA, 201 bp, Homo sapiens
tcctttagatagaagaaatattatgtcagagagacatttagattcataagaaggaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatga

SEQ ID NO: 81287 - DNA, 201 bp, Homo sapiens
tatttttagtagagacagggttttaccatgttggccaggctggtctcaaactcctgacctcgggcaatctgcctgcctcagcttcccaaagtgctgggatkacaggcatgagccattgcgcccggctgaacaatttattttcttttttggctatatacccagtaatagaattgctaggtcaaattgtagcaggacaagcca

SEQ ID NO: 81288 - DNA, 201 bp, Homo sapiens
cttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttccca

SEQ ID NO: 81289 - DNA, 201 bp, Homo sapiens
gcagaaagaatttctcactaacagagcagaaaaaaatgttaaaggaactcctttagatagaagaaatattatgtcagagagacatttagattcataagaargaatgaaaagttccagaagttgataaatatagagaaattttttcctcgttttaatctattaaaaaggcaattgattatctaaatgttaaagcaaaatagt

SEQ ID NO: 81290 - DNA, 201 bp, Homo sapiens
catgtttctactgactcttattgctccaggcagagcccaacctatccatagctatatgctaatcaatatgatttaattgaagttagcctcaaatccaaacycaaatatgatgtagaaatctcctttttgcatttacttgtttagatcagaatttctaagagatccaaatcccttttttaaaagaatatttacaattcagtt

SEQ ID NO: 81291 - DNA, 201 bp, Homo sapiens
aagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataaagcagaataaattgaa

SEQ ID NO: 81292 - DNA, 201 bp, Homo sapiens
tgtgagaactctataatattctgtaattaagcatttttctgtgtcctctcctcttactacccatgtttctactgactcttattgctccaggcagagcccarcctatccatagctatatgctaatcaatatgatttaattgaagttagcctcaaatccaaactcaaatatgatgtagaaatctcctttttgcatttacttgt

SEQ ID NO: 81293 - DNA, 201 bp, Homo sapiens
tacaactctttctctagacctcagccagacaaacctctctccagaactcagtcagacaaacctttccccagacctcagtgagatgcccctctttgcagatytcagtcaaattccccttaccccagacctcgaccagatgacactttctccagaccttggtgagacagatctttccccaaactttggtcagatgtccctttc

SEQ ID NO: 81294 - DNA, 201 bp, Homo sapiens
aggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaag

SEQ ID NO: 81295 - DNA, 201 bp, Homo sapiens
ctgatcaaatgcactctacttcagaccccagtcacagatcctcttctccagagctcagtgaaatgcttgagtatgaccgaagtcacaagtccttccccacmgatataagtcaaatgtccccttcctcagaacatgaagtctggcagacagtcatctctccagacctcagccaggtgaccctctctccagaactcagccaga

SEQ ID NO: 81296 - DNA, 201 bp, Homo sapiens
aatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattca

SEQ ID NO: 81297 - DNA, 201 bp, Homo sapiens
tgaacaaaattggtccagtaagaactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctatttta

SEQ ID NO: 81298 - DNA, 201 bp, Homo sapiens
aagaagagttcaatcttactgccctagctctggagaatggcactgaattcgtttcttcaaacacagatataattgttggttcaaattattcttccccaagkaatattagtaagttcactgtcaataaccttgcagaacctcagaaagccccttctcaccaacaagccaccacagctggttccccactgagacacctcattg

SEQ ID NO: 81299 - DNA, 201 bp, Homo sapiens
acttggtgatgaaatccgtgggtgacatcatagcaacatttttaagcaagaggtcaaaggctcacatccttagaaatgcgtttgatcttctattccaagcrtgtgtgtgtgtgtgtgtgtgtgtgtgtacacagacatactctgcgtggtgaggaaaagggtgagagagtaggactaatggaaggtgttatagtccatgtc

SEQ ID NO: 81300 - DNA, 201 bp, Homo sapiens
gaatagagaatcctttccctattgcttgcttttgtcacagatcagatagttgtaggtgcgcagccttatttctgagttctctattctgttccattggtctwtgcgtctgttcttgtaccagtactatactgttttgtcctccagagggcagcagacatcgaacagcaggctgtgtttgctgtgtttgatgagaacaaaagc

SEQ ID NO: 81301 - DNA, 201 bp, Homo sapiens
cttaacaagaccatactacagtgacgtggacatcatgagagacatcgcctctgggctaataggactacttctaatctgtaagagcagatccctggacaggygaggaatacaggtattttgtccttgaagtaacctttcagaaattctgagaatttcttctggctagaacatgttaggtctcctggctaaataatggggcat

SEQ ID NO: 81302 - DNA, 201 bp, Homo sapiens
atcaagtttctcaggaactttttaaaaaatccgcgtattttactgtggggagagtagataaagcctgagaaccctagttatctaatctgagaagtgggcaraggagttgtcataccaataagagaataaacatgacttgctatggttgctggatacaccaacgataaactcctaattttataaactcctagacttcctaat

SEQ ID NO: 81303 - DNA, 201 bp, Homo sapiens
tgcaatgaaatcagctctttataaaacgtcagcattgattcgcccattgcctacattatagcttctaaaagaatattctgaatctttgaatgtagtgaagsattcactaagtttattaacttaggagaggaaaagagttgttcacaaaaataagtaacaagggaagagttactgagtgagcaccctaatgagtaaccaaaa

SEQ ID NO: 81304 - DNA, 201 bp, Homo sapiens
aataaatctaaggcttggctgatccaggccccacttggctgctgaagggctggaggtgggaagagggatcaataaataggtgcactagaaacctgccatgrcacacctgtcaggagttgcagtacttccctttgggtggagagaagccaccatgattcacaatggagaaagtagctgaaacctggaatcagtttcctgttg

SEQ ID NO: 81305 - DNA, 201 bp, Homo sapiens
cctcagagccagagagctgtgtgatttggttcctcaattcatctaggtctctgagcacacccatgtcagagaaatctaaagtaactaccctctcgcatcamcctctgtaattgaaatgaacatctttcttaagcaaagaaagttattgctaaggaatgacagtgggtcaaagtgggcaagacttggccagaactatttctc

SEQ ID NO: 81306 - DNA, 201 bp, Homo sapiens
gctttacctgttttttctagtgccacttccccttggttttctcagacttctcttaccactcctgctcagtatccccaccagatattcttccccagggttcsaatctcacccaaaaccaaggctttcactactacctacccagaagccactttccctctgaagctacattgacaccccctcaataccagcagaattaaatct

SEQ ID NO: 81307 - DNA, 201 bp, Homo sapiens
ctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttgca

SEQ ID NO: 81308 - DNA, 201 bp, Homo sapiens
cttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccatggc

SEQ ID NO: 81309 - DNA, 201 bp, Homo sapiens
aatggagtatcagtgaggacagtggacccacccatgatgaccctccatgcctcacacacatctattactcccatgaaaatctgatcgaggatttcaactckgggctgattgggcccctgcttatctgtaaaaaaggtaagaacacccccaccaaaagattcaacaactaaatgttggaatggtcaggagttctgtcatggg

SEQ ID NO: 81310 - DNA, 201 bp, Homo sapiens
gacagaaagaaggcaagtaatccaaagatggattgacacatcaaagtagagcaaaatgagtatagggacccaagagtcttggaaaggcatgcatgaagacrtttcaagtgatcagtaagattttcagaacaaaaggaattccctgaatgagggttccggcatttgctgcagttctaaagttcagtggccaaaagcactgcc

SEQ ID NO: 81311 - DNA, 201 bp, Homo sapiens
gatttgagagtggtgaaaacgcaatcctcagaaactgcccacatgtcttgatggctgttactcctccaggtgcttcttaccttgaccacacattccctgcrgagaagatggacgacgctgtggctccaggccgagaatacacctatgaatggagtatcagtgaggacagtggacccacccatgatgaccctccatgcctca

SEQ ID NO: 81312 - DNA, 201 bp, Homo sapiens
tcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccctctacacttcttttaatattgagtatctc

SEQ ID NO: 81313 - DNA, 201 bp, Homo sapiens
ttttctgcctacggctagccagttttcccagaaccatttatggaatagagaatcctttccctattgcttgcttttgtcacagatcagatagttgtaggtgygcagccttatttctgagttctctattctgttccattggtctatgcgtctgttcttgtaccagtactatactgttttgtcctccagagggcagcagacatc

SEQ ID NO: 81314 - DNA, 201 bp, Homo sapiens
cagtttcaattttctgcctacggctagccagttttcccagaaccatttatggaatagagaatcctttccctattgcttgcttttgtcacagatcagatagytgtaggtgcgcagccttatttctgagttctctattctgttccattggtctatgcgtctgttcttgtaccagtactatactgttttgtcctccagagggca

SEQ ID NO: 81315 - DNA, 201 bp, Homo sapiens
agacacaacaaagtccactttatgctagcgcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgttaaccagatctccaggtttttg

SEQ ID NO: 81316 - DNA, 201 bp, Homo sapiens
tttcttttcttttcttttcttttttttttttttttagtagagacgggttttgccatgttgaccagactggtcttcaactcctgacctcaggtgatccaccsgccttggcctcccaaagtgctggtattacaggcgtgagccaccgcgccaggcctacatttaagtctttaatccatcttgagttaatttttgtatatgatg

SEQ ID NO: 81317 - DNA, 201 bp, Homo sapiens
caaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagaactgatcatcagaaagcagaaaagggca

SEQ ID NO: 81318 - DNA, 201 bp, Homo sapiens
tgaaataaaccaccccaaaacttagtgttaaaagagcaaccaaaaaaaatttatgtgagattatggatttgttacttagcttgatttaatcatcctgtaaygtgtacatatatcaaaatgttatgtataccataaatatataaaattttatcaacgaaattcataacaatctctcagaccacagagaaatcaaattagaac

SEQ ID NO: 81319 - DNA, 201 bp, Homo sapiens
ttttgtagtttggggttttacgtttaagtgtgttgttgttgttttttgtttgtttgtttctgttatttttgagatggagtctcgttctgttgcccaggctrgagtgcagtggtacgatctcagctcactgcaacctctgcctcccatgttcaggtgattctcctgcctcggcccctcggcctcccgagtagctgggattac

SEQ ID NO: 81320 - DNA, 201 bp, Homo sapiens
aagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgtta

SEQ ID NO: 81321 - DNA, 201 bp, Homo sapiens
tttgattacaaagtcaaaatcacattcaccaaaactgcatctcacaaatgcttcctcttaatagctgtttgtattttatactttatattaatgtatgttgyaaaatcaaagatacaacaaacctgttttattctagactaaaggtaaaataatttgaagtgaaaagaataaaagcattgataaaattacaccccaattgtc

SEQ ID NO: 81322 - DNA, 201 bp, Homo sapiens
ccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaat

SEQ ID NO: 81323 - DNA, 201 bp, Homo sapiens
caggagctctttatttcaattaaatcccatttgacaatttttgcttttgttgctattgcttttggcatgttcgtcatgaaagctttgcccatccctatgtyccaaataatattgcctaggttgtcttccagggtttttgtagtttggggttttacgtttaagtgtgttgttgttgttttttgtttgtttgtttctgttatt

SEQ ID NO: 81324 - DNA, 201 bp, Homo sapiens
aacaaaatccttttgagctctgtgcttttttgcataacttggtctaaaaaaaaagcaaaggttttaacatcttccttatctatgtgtttttgtcattttcrtaggcaaacaacaataagcagtggctagaaattgatctactcaagatcaagaagataacggcaattataacacagggctgcaagtctctgtcctctgaaa

SEQ ID NO: 81325 - DNA, 201 bp, Homo sapiens
tctcttcttttcagtttagagcttaattttttttattttgattacaaagtcaaaatcacattcaccaaaactgcatctcacaaatgcttcctcttaatagytgtttgtattttatactttatattaatgtatgttgtaaaatcaaagatacaacaaacctgttttattctagactaaaggtaaaataatttgaagtgaaaa

SEQ ID NO: 81326 - DNA, 201 bp, Homo sapiens
gttctttttgatggtcacatagtattctatggtgtatatgtaccatattttcttcatccagtctgtcattgatgggcatttgggttgatttcatgtctttrctattgtgaagagtgcgaaaatgaacatacgcatgcatgtgtctttataacagaatgatttatattcctttgggtacataccaagtaatggaattgctgg

SEQ ID NO: 81327 - DNA, 201 bp, Homo sapiens
ttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggt

SEQ ID NO: 81328 - DNA, 201 bp, Homo sapiens
gcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaaga

SEQ ID NO: 81329 - DNA, 201 bp, Homo sapiens
gcctagtatccattagttattttttctgatcctctccctctttccaccctccatcctctgataggccccagtatgtattgttcccttctatgtgtccatgygttctcataatttagctttcacttgtaagtgaaaacatgcagtatgtggttttctgttcttgcgttaacttgcttagaataatggcctccagctccatcc

SEQ ID NO: 81330 - DNA, 201 bp, Homo sapiens
aacggctatagtttgtatatttaataaatcacaaaaatgtggatcccttttccaaagagacttgcaagtcctgtgcaatgaaatcagctctttataaaacrtcagcattgattcgcccattgcctacattatagcttctaaaagaatattctgaatctttgaatgtagtgaagcattcactaagtttattaacttaggaga

SEQ ID NO: 81331 - DNA, 201 bp, Homo sapiens
ctcagtctcttgagtagctgggattacaggcgcccgccaccacccccatgtaatttttgtattttttagtagagacagggtttcaccatgttggctaggcyggtctcgaactcctgacctaaggtgttccacctgcctcagcctcccaaagtgctggtattacaggtgtgagccactgtgcccggctcttttgggatattt

SEQ ID NO: 81332 - DNA, 201 bp, Homo sapiens
gggttcaagtgattctcctgcctcagtctcttgagtagctgggattacaggcgcccgccaccacccccatgtaatttttgtattttttagtagagacaggrtttcaccatgttggctaggctggtctcgaactcctgacctaaggtgttccacctgcctcagcctcccaaagtgctggtattacaggtgtgagccactgtg

SEQ ID NO: 81333 - DNA, 201 bp, Homo sapiens
tcccaattatgctaaactgtaaccaaagaggtcttatctcaaggcatacaaaataaacatatgcctagaaaaagcagaaatgaatttctggacatatggamgatcctgatttattgagctaggaaaggaaacaggtagtagaagcataaggcttttctattgcaaccttctctttcatcctttgcacttattcagagcata

SEQ ID NO: 81334 - DNA, 201 bp, Homo sapiens
cccttatcctttttcatgtttgtagtgattttgcctgtttcatctctgatattgtcatctgcccctcctttcttttttgtgtgaatcttgctagagatttktcgattttaaaaaaatcttcttggccgggcgcagtggctcacgtctgtaatcccagcactttgggaggccgaggtgggcagatcacgaggtcaagagatc

SEQ ID NO: 81335 - DNA, 201 bp, Homo sapiens
gaataagtctactaaaattactctcacaaaagggcacctaggacttgaggtgccagagcctatgttcttttactactagacattactaggacatttaacaytcttcctttctgaagctctcgctttacctgttttttctagtgccacttccccttggttttctcagacttctcttaccactcctgctcagtatccccacca

SEQ ID NO: 81336 - DNA, 201 bp, Homo sapiens
cctaattaaatcacactgggtcacagtgatttctgcccttagatattcacaagattagacatgagatgcttctgagacacccagagctacaactaaaaccrgttccttaacattccagagggctgatgtaatctggcaggtgacactgtgggtgaggcaaaaagagaaagtctgaaagatagcacagagaagctgctgcaa

SEQ ID NO: 81337 - DNA, 201 bp, Homo sapiens
ctaatccctggagtttactttgtctgcccatatttgtatttatcttttgtagttaaggaaaattaagactgttaatggaaagtatacacgggtaaagcacrgaactgtaaaagctgaggaaaagagtgataaactgcttggaaagggagttccccctgccttctgctgtaggctggtgtgaatgatatgagaaggactagt

SEQ ID NO: 81338 - DNA, 201 bp, Homo sapiens
ggcaagaggattacttgagaggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtg

SEQ ID NO: 81339 - DNA, 201 bp, Homo sapiens
gacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactca

SEQ ID NO: 81340 - DNA, 201 bp, Homo sapiens
tcagtgacttttatgaagttatttaacctctgtgtgcctcatctttctcatctgtaaaatggtaataataatcatgtctctgtcatacaggtttgttgtcrtgaaatcttagaataatgactggcatataacagataataaatattagccatgatagtaaagataattcttcaattaaaatgtgttcaaataatttagtat

SEQ ID NO: 81341 - DNA, 201 bp, Homo sapiens
ctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaagggattccccaactca

SEQ ID NO: 81342 - DNA, 201 bp, Homo sapiens
caacatccaggtagcacagtggctggtatcccttccttgatcaagatataaataaccttgtaactttgaggtcaacttttgagaacatagtctcatcaggrctagaactttttttcatatttttatattttgtatttttattttttttgtagagaagaggttgcccaagatcaaactcctggcctcaagtaatcctccccc

SEQ ID NO: 81343 - DNA, 201 bp, Homo sapiens
tctgttcttgtaccagtactatactgttttgtcctccagagggcagcagacatcgaacagcaggctgtgtttgctgtgtttgatgagaacaaaagctggtmccttgaggacaacatcaacaagttttgtgaaaatcctgatgaggtgaaacgtgatgaccccaagttttatgaatcaaacatcatgagcagtaagtcagag

SEQ ID NO: 81344 - DNA, 201 bp, Homo sapiens
ttaaagaattcaattgaacaatgagaacatttagacacaggatggggaacatcacacaccggggcctgtcggggggggggggtggggggcggggggagggrtagcattaggagatatacctaatgttaatgacaagttaatgggtgcagcacaccaacatgacacatgtatacatatgtaacaaacctgcacgttgtgcac

SEQ ID NO: 81345 - DNA, 201 bp, Homo sapiens
tacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtc

SEQ ID NO: 81346 - DNA, 201 bp, Homo sapiens
attattggcatataatattgcctctggtcctatgaatctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtct

SEQ ID NO: 81347 - DNA, 201 bp, Homo sapiens
agggcctttgcgcacgctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaat

SEQ ID NO: 81348 - DNA, 201 bp, Homo sapiens
ccagaaatcagagtttaccattgcttctgtaaccagttactgcaaacttagtggctaaaacaacacaaatttattcttttatgattatatatctgcagatsagaagtccaaaatgggttttattgggctaaaatcaaggtgttggcagagctgcattccttctggaggctctgggggagaattgtttccttgtcttttcca

SEQ ID NO: 81349 - DNA, 201 bp, Homo sapiens
taatgggtgcagcacaccaacatgacacatgtatacatatgtaacaaacctgcacgttgtgcacatgtaccctagaacttaaagtataatttaaaaaaaawaaaaataaaagaattccttttgcaatattaattggttccagcgaaagcttatttatttatttattatcatgaaataactttgcaaatgaaaacaattttg

SEQ ID NO: 81350 - DNA, 201 bp, Homo sapiens
cccagaaatcagagtttaccattgcttctgtaaccagttactgcaaacttagtggctaaaacaacacaaatttattcttttatgattatatatctgcagaygagaagtccaaaatgggttttattgggctaaaatcaaggtgttggcagagctgcattccttctggaggctctgggggagaattgtttccttgtcttttcc

SEQ ID NO: 81351 - DNA, 201 bp, Homo sapiens
cacttctactgaatccaactagtaacttctgagaggctgccacatttttctgctattctccttgcccggtggtgtcactactgcagtcaggtagtatacaygtaggagtatcctaaaaatcacagccaaacccttctcacttcaggagttttgtctcttagtggtaacaaaatatggtgtcttttattagtgtcatagtgg

SEQ ID NO: 81352 - DNA, 201 bp, Homo sapiens
ccaaggcagatggatcacttgaggtcaggagttccagaccagcctggcccacatggtgaaaccccgcctctactgaaaatacaaaaattagttgtgcatgrtggtacatgcctgtagtcccagctactcaggaggctgagacatgagaatcacttgaacccaggaggtggaggctgcagtgagctgacatcgcatcacttc

SEQ ID NO: 81353 - DNA, 201 bp, Homo sapiens
gcctcccaaagtgctggggttacaggtttgagccactgaacctagctgagaagatgacttcaaagacagtgtcctaaaaaatctaccgggcaggggaaggkgatcatggtctagagatgagaagcagattcaaaatgagatgtggcccaagctgaaaagagaagggcaggggaaggaggacttgcttggagagagtgatac

SEQ ID NO: 81354 - DNA, 201 bp, Homo sapiens
tgaggccaggcgtggtggctcatgcactttgggaggccaaggcagatggatcacttgaggtcaggagttccagaccagcctggcccacatggtgaaacccmgcctctactgaaaatacaaaaattagttgtgcatgatggtacatgcctgtagtcccagctactcaggaggctgagacatgagaatcacttgaacccagga

SEQ ID NO: 81355 - DNA, 201 bp, Homo sapiens
tgggctcaggcgattctcgcacctcagcctctcaagtagctgggactacaggcacacgccccaacgcctggctaatttttgtatttttttgtagagatgakgtttcaccatgttgcccaggctggtcttgaactcctgagctcaagtgatccacctgcttcagcctcccaaagtgctggggttacaggtttgagccactga

SEQ ID NO: 81356 - DNA, 201 bp, Homo sapiens
gtgcagcacaccaacatgacacatgtatacatatgtaacaaacctgcacgttgtgcacatgtaccctagaacttaaagtataatttaaaaaaaataaaaawaaaagaattccttttgcaatattaattggttccagcgaaagcttatttatttatttattatcatgaaataactttgcaaatgaaaacaattttgaatata

SEQ ID NO: 81357 - DNA, 201 bp, Homo sapiens
tttgatttgcatttctctcatgaacactgatgttgagctttttaaaatgtgctttttggccgcatgtagttgcttttgcaaactaaggtaataaagagggmaggggaaaagtggttcatgtttctgctcccaaagtatttatcccagtagctacaaaagatgggtgaaggaggttgcttttcagtcagctcagagaattgg

SEQ ID NO: 81358 - DNA, 201 bp, Homo sapiens; identical to SEQ ID NO: 59826

SEQ ID NO: 81359 - DNA, 201 bp, Homo sapiens; identical to SEQ ID NO: 59827

SEQ ID NO: 81360 - DNA, 201 bp, Homo sapiens; identical to SEQ ID NO: 11472

SEQ ID NO: 81361 - DNA, 201 bp, Homo sapiens
ttatgtgaatgtattttctattaaaaacaattaaactaggaaaaagaacaaaaaaaatttggccaagattatagaattgttgacagaactgagataggaawccaggagtgtttggcaacagtcagtgctttccactgggaaaaataaattcataaaatgatattccatcttaaaagattgctgggttaaatgatatttctg

SEQ ID NO: 81362 - DNA, 201 bp, Homo sapiens; identical to SEQ ID NO: 59830

SEQ ID NO: 81363 - DNA, 201 bp, Homo sapiens
aaattaatatatggctacctagaaaattcagggagggtagggaggtcattttgagagtcatcagagaaaagtgagagttttcactgtaataaaaattatgygaatgtattttctattaaaaacaattaaactaggaaaaagaacaaaaaaaatttggccaagattatagaattgttgacagaactgagataggaatccagg

SEQ ID NO: 81364 - DNA, 201 bp, Homo sapiens; identical to SEQ ID NO: 59831

SEQ ID NO: 81365 - DNA, 201 bp, Homo sapiens
tttcttatttgtaagacataaaggtattctggaattacacgcatgaaattaatatatggctacctagaaaattcagggagggtagggaggtcattttgagrgtcatcagagaaaagtgagagttttcactgtaataaaaattatgtgaatgtattttctattaaaaacaattaaactaggaaaaagaacaaaaaaaatttg

SEQ ID NO: 81366 - DNA, 201 bp, Homo sapiens
gggggtcaaagtccaggttccccactccattgccacctaagaagggattgttccttggtggctgggtgggaagggaagttccccatttggcctccactgayactgcaggggcaggagcttcattaggggctggagatgaaagccctaaatccctacatggccttttctgacacaaccccagtgagggtgtagggtgcctct

SEQ ID NO: 81367 - DNA, 201 bp, Homo sapiens; identical to SEQ ID NO: 59832

SEQ ID NO: 81368 - DNA, 201 bp, Homo sapiens
tgtattggtttctattcaagtctttttgtaaaaattaatcttgaattacccccaaatcaccaaagaaattcagcctaataataataaaaatgacaacagcrgctaccttttgttgaatgtttgccattgccaagcactgtattgtccctttctgagagcttcgcttcaactctacaaactagatactgctcttatttcttt

SEQ ID NO: 81369 - DNA, 201 bp, Homo sapiens
tggttgaaatatgactgtgcctagagtcagagacatggattaaaatctactcgctaaggggcacctccaatcctcacttccagtccaaagacttggtgatraaatccgtgggtgacatcatagcaacatttttaagcaagaggtcaaaggctcacatccttagaaatgcgtttgatcttctattccaagcgtgtgtgtgtg

SEQ ID NO: 81370 - DNA, 201 bp, Homo sapiens; identical to SEQ ID NO: 59834

SEQ ID NO: 81371 - DNA, 201 bp, Homo sapiens
ctgagtaggtttcaccttggcctgtactttgaataagaccttaaggtatcagctcagccactctctccgagttctgcagttcctctatatgatgaccatgscttcttcaaggacaagccctagcaggaaggatcagcaggaagattgcagtaaagatgaacagattaggagtaatcctcaacacacaaaaaaaaccagcat

SEQ ID NO: 81372 - DNA, 201 bp, Homo sapiens; identical to SEQ ID NO: 59835

SEQ ID NO: 81373 - DNA, 201 bp, Homo sapiens
ataataaaagttcactattgaaggacatatgcatctccagagaactcatcttagctatccccagatttgagagtggtgaaaacgcaatcctcagaaactgyccacatgtcttgatggctgttactcctccaggtgcttcttaccttgaccacacattccctgcggagaagatggacgacgctgtggctccaggccgagaat

SEQ ID NO: 81374 - DNA, 201 bp, Homo sapiens; identical to SEQ ID NO: 59836

SEQ ID NO: 81375 - DNA, 201 bp, Homo sapiens
ggaaagtccaatatacatggaggtgttaatgatgtgtctttgggtgcacaaagtacaaagtaagacatctaagtttcaggggatggacacatttcatattyatacagacaaccagcctgcataggggagttagacgctgtggctcgggggaaaaaattgagataatcagatggctaagatgaaataaagagataaaacaaa

SEQ ID NO: 81376 - DNA, 201 bp, Homo sapiens; identical to SEQ ID NO: 59837

SEQ ID NO: 81377 - DNA, 201 bp, Homo sapiens
tattggccggtagttttcattattcattgtgtctttgccaggttttgttattagggtgatgctggctttgtagaataaaataaggaacagacaattagggrgtctttaatcactagaagttatagaagggctgggaggagcttcatgggtctgactgctggggtgtgaagacttctcatatggcatttaagtcctttacca

SEQ ID NO: 81378 - DNA, 201 bp, Homo sapiens
tgcaccagaacccaaccatgctggcaccctgattttaaacttccagcctccagaactgtgaggaagaagtgtccgttgtttataagccactcaatccaggktactttgttaacagcaacccaaactaagaaaatcaccaatttctatcttactcacatgtgttaccagaactcaagcacacttaagatctatcttatctaa

SEQ ID NO: 81379 - DNA, 201 bp, Homo sapiens
ctggttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaatatgcggacaaagaaaataaa

SEQ ID NO: 81380 - DNA, 201 bp, Homo sapiens
agaaactaccagagttacctgttgcccataccagtggggtaagccctatgaatgtatatgagagtttcaaacatccacaaaacattggctttctaatattygtattcccactattcctttcttttcatgattcatgtcattgtcccatcaacatttctaagatttccattccgttaagagcaaaagagaatgttggaaggt

SEQ ID NO: 81381 - DNA, 201 bp, Homo sapiens
aaattctgactcagccatcaactttttccctaactccccagacagaatttgtgcttcatcctctcttcttctgtaatattttgcccatatctcagcagtcrctcctatcatacatctatctccaaactagcttgtgagttccttcagtacagggactgtatttgatccaggtagccagaaactttctaacacagtgcctgg

SEQ ID NO: 81382 - DNA, 201 bp, Homo sapiens
ttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatct

SEQ ID NO: 81383 - DNA, 201 bp, Homo sapiens
gcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaata

SEQ ID NO: 81384 - DNA, 201 bp, Homo sapiens
acctagatgctagcacaagacaaactgcaaatttacagaagcactaagttgtagaaagtgtaaaagtttagcatgaaaacattaacctttacagtgggatraacacaaagtctagcacagagaggaactcaatgaatgtgtgttgaatggatcatacatggcatatactgaggggtgagctccaaagaacactggggaatt

SEQ ID NO: 81385 - DNA, 201 bp, Homo sapiens
catacatagagatattctttcttcgggttacttcatatgcaaaaaagacctagatgctagcacaagacaaactgcaaatttacagaagcactaagttgtaraaagtgtaaaagtttagcatgaaaacattaacctttacagtgggatgaacacaaagtctagcacagagaggaactcaatgaatgtgtgttgaatggatca

SEQ ID NO: 81386 - DNA, 201 bp, Homo sapiens
aaacttagatattttgctcttagatttataacttgctctttggggatggagaaagcgaaggaattggcaaaggtttttttttttttttttttttttttttwaattaagcaaaagctaaagagatctctaacttcctcgaaagaagaaaagaggaagaaaacaaatgcatacatagagatattctttcttcgggttacttca

SEQ ID NO: 81387 - DNA, 201 bp, Homo sapiens; identical to SEQ ID NO: 59845

SEQ ID NO: 81388 - DNA, 201 bp, Homo sapiens
gtttgatcacagagtacttgactgaatgcttattttggcctgtgtctctccctctttctcagatataacagtttgtgcccatgaccacatcagctggcatytgctgggaatgagctcggggccagaattattctccattcatttcaacggccaggtcctggagcagaaccatcataaggtctcagccatcacccttgtcag

SEQ ID NO: 81389 - DNA, 201 bp, Homo sapiens
aacaaaaaaaaaaaaaaaatcttttcacagaaccagccttgttttattgatttttctctattgtttttctgttttcagtattaccgatacctgctccaatyttctgttttaaaaagttggctttttctgacattgctctgtcaggaaaaggggtagggcacagcctgtttactgccaagtgggggtcaaagtccaggttcc

SEQ ID NO: 81390 - DNA, 201 bp, Homo sapiens; identical to SEQ ID NO: 59848

SEQ ID NO: 81391 - DNA, 201 bp, Homo sapiens
ttcccaaaagaataattgggggtaaatgggacaaggtagggaaagaccatcagtagaaactaagaatagtaaacatttgtaaaaaccctctgccttataargcagaataaattgaatacatatgataaatgctaacacagatatgttaattgctgaactcaatataagcatttctttggcatggataaacgcttccaccaa

SEQ ID NO: 81392 - DNA, 201 bp, Homo sapiens
gaaggcagcccctcgacagcactttgggtgacgttgtgtgaatctgcctcagatgcagacacagaagtccaaatggactggtttgattaagagcagggaaraaaagagggttcttattggtttttcacatgccagtaactcactaatacatctagagagtattaattgtattatattaatatcatattaattaattaatat

SEQ ID NO: 81393 - DNA, 201 bp, Homo sapiens; identical to SEQ ID NO: 59850

SEQ ID NO: 81394 - DNA, 201 bp, Homo sapiens
ggtcaggagttctgtcatgggacaaagcttgggagcatcttggtaacttcttgtacatcaagcagaggaagacggcacggagaccagatcattgtttgacmagagaaaaaaacacctgctatttcagggtgtggatccacctctgtttcttctcattcctccttcatctcagtccttaaggttctcccaggcaaattcctg

SEQ ID NO: 81395 - DNA, 201 bp, Homo sapiens
taccatattgaacaatgcagttatagaccatttagaaaaacatctagaatgaggtataaactaataatacatcatgtaaattattaaagtcacttaagtgrtttaagtaggtatttaaatatttgttaatgccagtcattatactggtactaaggctaagagtggtaatcgaggtagacatgagccctgcccttgtagaaa

SEQ ID NO: 81396 - DNA, 201 bp, Homo sapiens; identical to SEQ ID NO: 59853

SEQ ID NO: 81397 - DNA, 201 bp, Homo sapiens; identical to SEQ ID NO: 59856

SEQ ID NO: 81398 - DNA, 201 bp, Homo sapiens
cctaataaatgagcactggatagaattgtcagaaggatttagaaacagtgggtggataaaattagactacaggctgctgaggaggcaacagaataaaaaayaagatttgatttcaagtatcttaactgtgaataaaactcaatactagttaacaagaatgcaacaaacaacaatgtaaattcacaatgttaataaaaataa

SEQ ID NO: 81399 - DNA, 201 bp, Homo sapiens
caatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgag

SEQ ID NO: 81400 - DNA, 201 bp, Homo sapiens
caacaacaaacaaacaggtatcacaatcagagatcaagaagggtgtaagatgatatttgatctgacatctgaagaatgagcacacatttacccagaaaaakaaagggaggaagaacttcaaaagttatctcctaccctgcaaagaatataatgttttgcccttaggggagcttgtgaaggcagtggaaagaatatcatttt

SEQ ID NO: 81401 - DNA, 201 bp, Homo sapiens
ttcaactctgaccctgaagttcaagtgctttctcccactatctagcagaaaaaagtatcgttaaccatatagtctcacaaatactgaattacaaatggcgmtgagtgctgtcaaaaaaccaacaacaaacaaacaggtatcacaatcagagatcaagaagggtgtaagatgatatttgatctgacatctgaagaatgagca

SEQ ID NO: 81402 - DNA, 201 bp, Homo sapiens
ctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtga

SEQ ID NO: 81403 - DNA, 201 bp, Homo sapiens
ctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatat

SEQ ID NO: 81404 - DNA, 201 bp, Homo sapiens
tttagcctcaggagcatagaagtctaggctccccattcagcctttgctgttgtgggttggggaggggcctcaggtttttctgtggtgtttggctaaaggasagaagtcagtgtccaccagttttctatcatatctcgctatgctgccctttactggtactttggttagagaaagcagattttatttgggctttttcagtct

SEQ ID NO: 81405 - DNA, 201 bp, Homo sapiens
ttgcctgtttcatctctgatattgtcatctgcccctcctttcttttttgtgtgaatcttgctagagatttgtcgattttaaaaaaatcttcttggccgggygcagtggctcacgtctgtaatcccagcactttgggaggccgaggtgggcagatcacgaggtcaagagatcaagaccatcctgaccaacatggtgaaaccc

SEQ ID NO: 81406 - DNA, 201 bp, Homo sapiens
agaatggagcacaaaatatttactatacatttgacgaatgactaaatcaatgtaaatggaaggctttatctttttcctgagatttctcctttggctaattyaggagaataatctctcatttgaaaattctgagtttgatcttctagtcacatgttagactagataaagcttatcttggataatcactgctttgacacaacc

SEQ ID NO: 81407 - DNA, 201 bp, Homo sapiens
acatttgtactctggcatttagcacagagcctggaacctagtggatgatgatggtcatgatcatgatgatattaatcattactgaactaaactgaggggcygaggactgattagaaagtaaggactatgcattatttttcccttgctttaaaattattgattttgctgataattttgagcaggtactttgtcttacttatt

SEQ ID NO: 81408 - DNA, 201 bp, Homo sapiens; identical to SEQ ID NO: 59871

SEQ ID NO: 81409 - DNA, 201 bp, Homo sapiens
attttatcatcaaacaaaatacccagatttctcagactggccaatggtatacggcagagtagaacatctggtcttgcgcctcaaggagctcatgctaaaarttggctaccaagacttttgattttactattgtagtttgttttgttctttatttcagtgtacctgaagtaaatagtagtgttaatgctagtaagcctctga

SEQ ID NO: 81410 - DNA, 201 bp, Homo sapiens
ccactaagcaacacttttgttttttattctgttaagcgagatgaacgcactggtcatgtgcttagagtcacagcaatgtcaaattgctttagaaaaacaaragtttactaaatatttcattctcatttttctctccttgtgttattttgacccagtaatcaataggtcacagacaagcagtggtccacagcccatacttga

SEQ ID NO: 81411 - DNA, 201 bp, Homo sapiens; identical to SEQ ID NO: 59881

SEQ ID NO: 81412 - DNA, 201 bp, Homo sapiens
caaattcctgtttgagagtatgttctgatgtcatgcttgtatgatctgtaacatttacctcaaggccaaagtcttttagaaagtatacagtagcctatacyctgctgaaagagctcttggaaagaactttggctaacatgtttgacatatctgaggtttgggctggtaatttgctctataaacacgtgaaatgccagcttc

SEQ ID NO: 81413 - DNA, 201 bp, Homo sapiens
atttactctgtttttccaggaaaaagatattcactcaggcttgataggtcccctcctaatctgccaaaaaggaatactacataaggacagcaacatgcctrtggacatgagagaatttgtcttactatttatgacctttgatgaaaagaagagctggtactatgaaaagaagtcccgaagttcttggagactcacatcctc

SEQ ID NO: 81414 - DNA, 201 bp, Homo sapiens
cattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaaaacaaaaacaaaaaacctt

SEQ ID NO: 81415 - DNA, 201 bp, Homo sapiens
acaaccaccaagatattttcaactctgaccctgaagttcaagtgctttctcccactatctagcagaaaaaagtatcgttaaccatatagtctcacaaataytgaattacaaatggcgatgagtgctgtcaaaaaaccaacaacaaacaaacaggtatcacaatcagagatcaagaagggtgtaagatgatatttgatctga

SEQ ID NO: 81416 - DNA, 201 bp, Homo sapiens
ttacaaatattttccagtcttcataacccatcaaaaaggataaagttatctctagaaaaaggattatattatcttaaattataaatgaaaaaactgaggtyaaagggacttcaagaaaccttcccaagttcccacagttagcaaatgatacaaccaccaagatattttcaactctgaccctgaagttcaagtgctttctcc

SEQ ID NO: 81417 - DNA, 201 bp, Homo sapiens
aataaaccaccccaaaacttagtgttaaaagagcaaccaaaaaaaatttatgtgagattatggatttgttacttagcttgatttaatcatcctgtaatgtrtacatatatcaaaatgttatgtataccataaatatataaaattttatcaacgaaattcataacaatctctcagaccacagagaaatcaaattagaactga

SEQ ID NO: 81418 - DNA, 201 bp, Homo sapiens
tgcaggttagttacatatgtatacatgtgccatgctggtgcgctgcacccactaactcgtcatctagcattaggtatatctcccaatgctatccctccccbctcctttgggagatttttaggtaatgaggatggagccctcatgatgagattagtgcccttataaaagggaccctctcactcaccctctttctaccatgtg

SEQ ID NO: 81419 - DNA, 201 bp, Homo sapiens
catataaatggagactaaaatctaaggaaatgatatcacaataggaaatcattttgttaccaaaataatgtataagcaacacatataaggaagagatactycatgagatcatttctgtttcttttcacacgagtagtcaaaattatatttgaagtaataaaaccatcatgatatccgtggaagatagagttcccaataata

SEQ ID NO: 81420 - DNA, 201 bp, Homo sapiens
ctaaacttaattaacatcattcatttaattatttgaaattcatcttatatgtaactgacaggcgaatgtgaaattctgagtaatttagtttgatcaattaracagacattaatttgtgtgactagagtaacctttcattatctatctcaaaatatcatgtacacaagtatatacaataattttttaagcccagtatgtgtt

SEQ ID NO: 81421 - DNA, 201 bp, Homo sapiens
aattatcagaaggtaagataaatctaatatttttctgaaaagggaaaatgtctaagtctttaataccagcatcaacatttaaaactatactgttaaccacrtgttgttagggaaatctcttgcaactggtaattataaaaattgttgctgttgtaagttttgagagaagaaaaggaaaaggttttggagtcctctagacct

SEQ ID NO: 81422 - DNA, 201 bp, Homo sapiens
cagagtattccctccttttctgtcataatatttaccataggtttaaattgaatgtttttgtgatcatttgtttaaaatctgtctttcctactataaaaacktataaagttatagaactataaaaatgtttgacttttataaactctatgaaggcagggagtgggtgtatctattttactcttttacgcaccattgcaattc

SEQ ID NO: 81423 - DNA, 201 bp, Homo sapiens
aaagtcctttcagatgattaaattttttagtgatttcctgatttaaccttgttagaggtagactctgacagttggtgagaacagtctccaatttatgtgtraggcctttgcacctttctgtcaacccctgtgtatctcagaatatatttgtttcatgtggacaaaggtgtttcgacgtccattttaatgtaatctcttcct

SEQ ID NO: 81424 - DNA, 201 bp, Homo sapiens
tttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcc

SEQ ID NO: 81425 - DNA, 201 bp, Homo sapiens
aaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaa

SEQ ID NO: 81426 - DNA, 201 bp, Homo sapiens
tgctcaaagagacctctggccaaactggcaagcagttaaagttttctttcagggccttcctctctatggcctcaacttcctcctctctcttcttccagcarcttcccctttcatcattcctttccctggggacttggcattcagtgatcctgtagatattgcacaactggggaacctttagacatccttaaaatcacatga

SEQ ID NO: 81427 - DNA, 201 bp, Homo sapiens
ctttttgttttaggatgaacttttaatacacgttatactatgtctctgctgtacaaagtggtttttcattttacttagaaatgctccatttcacttagacraggcgtggtggctcacacctgtaatcccagcactttgggaggctgaggcgggtgtatcacctgaggtcaggagtttgagaccagcctggccaacatggtg

SEQ ID NO: 81428 - DNA, 201 bp, Homo sapiens
ggggccggtatttgaaggtgtaccttttgtggcttttgccaagctaagcaaattttaatccctttgctgtgtgagacattgtgctaaatgccataagagayggaaaggactaattccaggctgaagacttttaaacaataaaaaggcatggatagcttttgaagaaaagggttctgtgatcaaagtcctttcagatgatta

SEQ ID NO: 81429 - DNA, 201 bp, Homo sapiens
cctattactagaatattaccaacttttagattggaaatattcaactctaagaactctgatgtgacaaaggcataatttgtagccataattgcttttattcyggcccatggtctgattgcattgaaaacacatcagtcagatcaaaagcattcctgtcaattgggaaacctgtgtaaagcatccttcttcatgacttgtgat

SEQ ID NO: 81430 - DNA, 201 bp, Homo sapiens
tcaatgtatattttatactcacagcatatctcagtccagtctacccatatttcaagtgctcgataaccacttgtagccagtggctaccatattgaacaatrcagttatagaccatttagaaaaacatctagaatgaggtataaactaataatacatcatgtaaattattaaagtcacttaagtgatttaagtaggtattta

SEQ ID NO: 81431 - DNA, 201 bp, Homo sapiens; identical to SEQ ID NO: 59933

SEQ ID NO: 81432 - DNA, 201 bp, Homo sapiens
tgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctgtttactggctttcctatattgcaggtggacatgcaaaag

SEQ ID NO: 81433 - DNA, 201 bp, Homo sapiens
ttttcactgggttcttactctttaatgtttgggagggcaagttatctaatttctctgaattctcatatgttcatcttaaaatgggaataataatacatacrttgaaagatggtttaaggcgggggtcagtaaatttttccgtaaagggccagatagtaagtttgtttggctttgcaggccataagatctctgttgcaagta

SEQ ID NO: 81434 - DNA, 201 bp, Homo sapiens; identical to SEQ ID NO: 59937

SEQ ID NO: 81435 - DNA, 201 bp, Homo sapiens; identical to SEQ ID NO: 59936

SEQ ID NO: 81436 - DNA, 201 bp, Homo sapiens
tgtgtgtcttttctaaaataagaatgacgctaacagttttagctctcagcagctaccaggtggcacccaaagcatatgagaacaaaatgagataagaaacyaggtacccaggtaataggagaatagtggcaagagagcatttgggtggtcacactgggaaaagtgtgcctatttggaaattcacaaggaaaatttgccctg

SEQ ID NO: 81437 - DNA, 201 bp, Homo sapiens; identical to SEQ ID NO: 59940

SEQ ID NO: 81438 - DNA, 201 bp, Homo sapiens; identical to SEQ ID NO: 59939

SEQ ID NO: 81439 - DNA, 201 bp, Homo sapiens
tacttgggaggttgaggtaggagaattgcttgaacccaggaggcggaggttgcagtgggtcctgagattgcatcactgcactccagcctaggagacagagygagactccatctcaaaaaaaaaaagaaaaatgctccagtgatgtcccatttcacttagaagaaaattcaagttcttaccgtagcccatagggcctccctt

SEQ ID NO: 81440 - DNA, 201 bp, Homo sapiens; identical to SEQ ID NO: 59944

SEQ ID NO: 81441 - DNA, 201 bp, Homo sapiens; identical to SEQ ID NO: 59942

SEQ ID NO: 81442 - DNA, 201 bp, Homo sapiens
cattttattcttgattcatccctttcttaatatattttaaaatagtgagcaactatctgtgctgaaagaccttttttcccctctaatctccactaagcaayacttttgttttttattctgttaagcgagatgaacgcactggtcatgtgcttagagtcacagcaatgtcaaattgctttagaaaaacaaaagtttactaaa

SEQ ID NO: 81443 - DNA, 201 bp, Homo sapiens
aatagcttcacttactaaaacacaaatattgttaagagttgagatctgggtagtgtttttaaattgtattctatttcatttgactacattttccacttggktttctgaaaatatactcatatgactctcaatgttgatcccaagttccaatactaggagcttgtaaaaactggggcttagttaactgacctcgaccttaga

SEQ ID NO: 81444 - DNA, 201 bp, Homo sapiens
agaaggaaatattttctctttttttttttaaacaggaaatagaagagacaaattagaagctagagaagaaatgtgcagccttgttaggtatagtgacctgrgtaggtttcaccttggcctgtactttgaataagaccttaaggtatcagctcagccactctctccgagttctgcagttcctctatatgatgaccatggctt

SEQ ID NO: 81445 - DNA, 201 bp, Homo sapiens
ggtacatgtgcacattgtgcaggttagttacatatgtatacatgtgccatgctggtgcgctgcacccactaactcgtcatctagcattaggtatatctccmaatgctatccctcccccctcctttgggagatttttaggtaatgaggatggagccctcatgatgagattagtgcccttataaaagggaccctctcactcac

SEQ ID NO: 81446 - DNA, 201 bp, Homo sapiens
actcatcacgttctgctacatgtgctggcccagtacactgcagtctctttcctatactgcctaatctctctgcttccattcttgtccctacacagactatyctctacacagcagctatgatgaactttttgttttaggatgaacttttaatacacgttatactatgtctctgctgtacaaagtggtttttcattttactta

SEQ ID NO: 81447 - DNA, 201 bp, Homo sapiens; identical to SEQ ID NO: 59953

SEQ ID NO: 81448 - DNA, 201 bp, Homo sapiens
taggagactgtgaatcctaagggataagatagaacaaaatccttttgagctctgtgcttttttgcataacttggtctaaaaaaaaagcaaaggttttaacmtcttccttatctatgtgtttttgtcattttcataggcaaacaacaataagcagtggctagaaattgatctactcaagatcaagaagataacggcaattat

SEQ ID NO: 81449 - DNA, 201 bp, Homo sapiens
taagatacctacactccaatttcctggctttctatagaattccagggcctatccttaaattaggccactagaaaggaaaaaagaattgtggtgctggtggsgtaaatagaaaagattggattccacacagtcttgggaactgatatctgtgtcttgaaactcattctggcccaatatggaatcacagaatgttacagtagc

SEQ ID NO: 81450 - DNA, 201 bp, Homo sapiens
aatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcat

SEQ ID NO: 81451 - DNA, 201 bp, Homo sapiens
tcttactgttccttagatacatcaagactactcctgcctcagagccagagagctgtgtgatttggttcctcaattcatctaggtctctgagcacacccatktcagagaaatctaaagtaactaccctctcgcatcaccctctgtaattgaaatgaacatctttcttaagcaaagaaagttattgctaaggaatgacagtgg

SEQ ID NO: 81452 - DNA, 201 bp, Homo sapiens
aataattgttcaggtaccctggaaaattaacttgctaaactttaatttacaaataacatttgttattcttaagatcaccatgttatcaaagcctttgtaastacatgagcatagaaatgggcatatgtgaatctttccaaataataaaagttcactattgaaggacatatgcatctccagagaactcatcttagctatccc

SEQ ID NO: 81453 - DNA, 201 bp, Homo sapiens
gattttattatgccctctgcattaaaataaaacatctcctcctccatgtctgacactcaccctcacctatagcctccctctgtggtttgagctattttttkgggagtggggataaactaactgcatgctgagccagttacatgagaatccagattcctctatctcagaggtagatatttgagagataggtggtagggggtt

SEQ ID NO: 81454 - DNA, 201 bp, Homo sapiens
ctgtgtgcctcatctttctcatctgtaaaatggtaataataatcatgtctctgtcatacaggtttgttgtcgtgaaatcttagaataatgactggcatatracagataataaatattagccatgatagtaaagataattcttcaattaaaatgtgttcaaataatttagtatttatcttaaaacttgttagtttcagaaaa

SEQ ID NO: 81455 - DNA, 201 bp, Homo sapiens
tttgcaggccataagatctctgttgcaagtactcaactctgccttttagtacaaaagcagccatagacgatacctatttttttggctttggttacagatgycagaactaattaactttgttaccgtattctttccctcaagtcatacaccagagtaagaccgcctctgacaatacaattttatttacaaaaacaggaaatt

SEQ ID NO: 81456 - DNA, 201 bp, Homo sapiens
aatatgactgtgcctagagtcagagacatggattaaaatctactcgctaaggggcacctccaatcctcacttccagtccaaagacttggtgatgaaatccrtgggtgacatcatagcaacatttttaagcaagaggtcaaaggctcacatccttagaaatgcgtttgatcttctattccaagcgtgtgtgtgtgtgtgtgt

SEQ ID NO: 81457 - DNA, 201 bp, Homo sapiens
tgaaattaatatatggctacctagaaaattcagggagggtagggaggtcattttgagagtcatcagagaaaagtgagagttttcactgtaataaaaattaygtgaatgtattttctattaaaaacaattaaactaggaaaaagaacaaaaaaaatttggccaagattatagaattgttgacagaactgagataggaatcca

SEQ ID NO: 81458 - DNA, 201 bp, Homo sapiens
ggtcatccttgacttctgtctctcacaagccacatgcaatccatcagcaagtcttgtttgccttacctacaaaaatgtccagactccaaccactactcatyacgttctgctacatgtgctggcccagtacactgcagtctctttcctatactgcctaatctctctgcttccattcttgtccctacacagactattctctac

SEQ ID NO: 81459 - DNA, 201 bp, Homo sapiens
gggcactgaggagagggttagaagggttttaggccatctggctgttggaggagctaaagagcagcttgaaaaccatttagccatgtgttttcctacatgcrtgaaagtatttggtatgcatttatgaaaacatccttttgttttgccttaaatctgaagaagcaggaggggaggttgaataaatactccaaactgtccact

SEQ ID NO: 81460 - DNA, 201 bp, Homo sapiens
gcactaaattgggtacatgctgtgctggcttccccaagccctgaagtaggccactcctttccccaatccagctttgggcactgaggagagggttagaaggkttttaggccatctggctgttggaggagctaaagagcagcttgaaaaccatttagccatgtgttttcctacatgcgtgaaagtatttggtatgcatttatg

SEQ ID NO: 81461 - DNA, 201 bp, Homo sapiens
tggctacataatatgtggggcccagtgcaaaatgaaaatgtgagtccccttgttcatattattgaaaatttcacagtgactgcaaagcattaaaccaagcyaggggccctttggggcatggggccctgtgaaactgcccaggtcacatacccatgaagctggctctgtttttaaccttgattaaaataactaaataaaact

SEQ ID NO: 81462 - DNA, 201 bp, Homo sapiens
gaggaaaagggtgagagagtaggactaatggaaggtgttatagtccatgtcaatagtatcctagactgagttcagggtgaatatatggctaggacagaaasaaggcaagtaatccaaagatggattgacacatcaaagtagagcaaaatgagtatagggacccaagagtcttggaaaggcatgcatgaagacatttcaagt

SEQ ID NO: 81463 - DNA, 201 bp, Homo sapiens
tgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatt

SEQ ID NO: 81464 - DNA, 201 bp, Homo sapiens
aagcttgtttcatggagaatttaatattattcttttcttttagttatattctcatattttaaatatatgagttgcatatgaatgtgatgtcacaaaattasttctataatatatagccatctgctggtaagccagctctccaaataaaacacgttttctgccagacattgttcgttgtatctaagtgttgccaaattctct

SEQ ID NO: 81465 - DNA, 201 bp, Homo sapiens
gtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgt

SEQ ID NO: 81466 - DNA, 201 bp, Homo sapiens
ttccagattgacagtgtgttctaattgtagccctagaagaaatctagaggtcaaacctatcacaattagggcaccaacatgtaccctagagttaactaggyagagcccctcaggggcccaggccctgtcttctttacatttgtactctggcatttagcacagagcctggaacctagtggatgatgatggtcatgatcatga

SEQ ID NO: 81467 - DNA, 201 bp, Homo sapiens
tttattggccttttaccccatcatgtaaaacatttcaggcttttttccccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaat

SEQ ID NO: 81468 - DNA, 201 bp, Homo sapiens
tatgttcatcttaaaatgggaataataatacatacattgaaagatggtttaaggcgggggtcagtaaatttttccgtaaagggccagatagtaagtttgtytggctttgcaggccataagatctctgttgcaagtactcaactctgccttttagtacaaaagcagccatagacgatacctatttttttggctttggttaca

SEQ ID NO: 81469 - DNA, 201 bp, Homo sapiens
ctaaaaggatttcagcaggagaaatatttgtcctttagaaagattatgttgtccaattatagagaatagattggagaaagaccagtccagagccagagaargtagtcatgggactgttgtatcaatccagatagcagagaagctgagatggagtccaaagatatttaggagctaaagttgattaaacttggtgactcatta

SEQ ID NO: 81470 - DNA, 201 bp, Homo sapiens
ggctggagagcagtggcaccattttagatcactgcaacctctgcctcctgggttcaagtgattctcctgcctcagtctcttgagtagctgggattacaggygcccgccaccacccccatgtaatttttgtattttttagtagagacagggtttcaccatgttggctaggctggtctcgaactcctgacctaaggtgttcca

SEQ ID NO: 81471 - DNA, 201 bp, Homo sapiens
acatgttatccaggttccaagtagaatatttaaagaattcaattgaacaatgagaacatttagacacaggatggggaacatcacacaccggggcctgtcgsggggggggggtggggggcggggggagggatagcattaggagatatacctaatgttaatgacaagttaatgggtgcagcacaccaacatgacacatgtata

SEQ ID NO: 81472 - DNA, 201 bp, Homo sapiens
ttgaaattcatcttatatgtaactgacaggcgaatgtgaaattctgagtaatttagtttgatcaattagacagacattaatttgtgtgactagagtaaccyttcattatctatctcaaaatatcatgtacacaagtatatacaataattttttaagcccagtatgtgttaaaataaatctaggtgtgaaacattgattgtt

SEQ ID NO: 81473 - DNA, 201 bp, Homo sapiens
tcttgatttctgcacccataacctcctgtctctgctgtgttctcccattgcagtaactaataacatcatttacccagttgttctgataaaacaccttgagktcatccttgacttctgtctctcacaagccacatgcaatccatcagcaagtcttgtttgccttacctacaaaaatgtccagactccaaccactactcatca

SEQ ID NO: 81474 - DNA, 201 bp, Homo sapiens
agaggtcaagctttaattattcaggctaaacaaataattgaacagcttgcatggacttttttcagtgggtttaactgacctaattatgtttttctcagggrtagggactattggcattagtttacatcctgagcccacaggcctagtataggattcagaaattatcaaactatccacaaatttgaagatttaaataaaatc

SEQ ID NO: 81475 - DNA, 201 bp, Homo sapiens
tcaaacattccccattcaagaccctgatcaaatgcactctacttcagaccccagtcacagatcctcttctccagagctcagtgaaatgcttgagtatgacygaagtcacaagtccttccccacagatataagtcaaatgtccccttcctcagaacatgaagtctggcagacagtcatctctccagacctcagccaggtgac

SEQ ID NO: 81476 - DNA, 201 bp, Homo sapiens
gccttgtgggatggaatcagactgtgaaaacttttggagatgatttaacctaggtcatctgatattagatgtgtatgaaggcaacctgtgcagaactccaragaagagaggactgggataaggatcaataaaaaccaggataaataagagctttatgctcaaattcagggcccagttaagctttctctgacatacctactc

SEQ ID NO: 81477 - DNA, 201 bp, Homo sapiens
agacactatgagcctattaagcctaacagattacaccctgagtagtaaagaaaaagacaattagatgagtagccttgtgggatggaatcagactgtgaaarcttttggagatgatttaacctaggtcatctgatattagatgtgtatgaaggcaacctgtgcagaactccaaagaagagaggactgggataaggatcaata

SEQ ID NO: 81478 - DNA, 201 bp, Homo sapiens
agcaataaatctaaggcttggctgatccaggccccacttggctgctgaagggctggaggtgggaagagggatcaataaataggtgcactagaaacctgccrtggcacacctgtcaggagttgcagtacttccctttgggtggagagaagccaccatgattcacaatggagaaagtagctgaaacctggaatcagtttcctg

SEQ ID NO: 81479 - DNA, 201 bp, Homo sapiens
ctctgcgtggtgaggaaaagggtgagagagtaggactaatggaaggtgttatagtccatgtcaatagtatcctagactgagttcagggtgaatatatggcyaggacagaaagaaggcaagtaatccaaagatggattgacacatcaaagtagagcaaaatgagtatagggacccaagagtcttggaaaggcatgcatgaag

SEQ ID NO: 81480 - DNA, 201 bp, Homo sapiens
atatggctacctagaaaattcagggagggtagggaggtcattttgagagtcatcagagaaaagtgagagttttcactgtaataaaaattatgtgaatgtaytttctattaaaaacaattaaactaggaaaaagaacaaaaaaaatttggccaagattatagaattgttgacagaactgagataggaatccaggagtgtttg

SEQ ID NO: 81481 - DNA, 201 bp, Homo sapiens
ttttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttat

SEQ ID NO: 81482 - DNA, 201 bp, Homo sapiens
ggaggataaatatcattgtcataaaaaaaagagtgattttatttctggtgtgtgtaaaccttggggaacttgctgatgatggaagggggaaagttatacamtttagttgaggatataaggtacatgccaacaagaataaataaattaaaatgcatggtcacattttaaatgttagcaatagtcaaacatttattggtggcc

SEQ ID NO: 81483 - DNA, 201 bp, Homo sapiens
ggtgacgttgtgtgaatctgcctcagatgcagacacagaagtccaaatggactggtttgattaagagcagggaaaaaaagagggttcttattggtttttcmcatgccagtaactcactaatacatctagagagtattaattgtattatattaatatcatattaattaattaatataataattaatagataatttattgtat

SEQ ID NO: 81484 - DNA, 201 bp, Homo sapiens
gaaagaccatcagtagaaactaagaatagtaaacatttgtaaaaaccctctgccttataaagcagaataaattgaatacatatgataaatgctaacacagrtatgttaattgctgaactcaatataagcatttctttggcatggataaacgcttccaccaaagcctcctagtgatgcaaggaatcctggctttgttgcaat

SEQ ID NO: 81485 - DNA, 201 bp, Homo sapiens
tgtaaaatcaaagatacaacaaacctgttttattctagactaaaggtaaaataatttgaagtgaaaagaataaaagcattgataaaattacaccccaattktctcattagccatctcactcagtgtaattatagaatatatcctatgtacaagtctatatcattcactgtttcaagatgctcataattcaacttttagtag

SEQ ID NO: 81486 - DNA, 201 bp, Homo sapiens
tgatagtgtggtttcatatttgccagcattatgaataatcttctctgcactcctagcagctagaattttaaataaaaagttatcatatttcttcaggtggmaaaataattgtgaaacacaatgttcttggcagaaaataaaacccaaatgactaaatacaacatatttttaggcatgtgtgaatgaatatatttctctctc

SEQ ID NO: 81487 - DNA, 201 bp, Homo sapiens
gccagctctccaaataaaacacgttttctgccagacattgttcgttgtatctaagtgttgccaaattctctatacaaaaatttgctcttctagatttttcyaaaacattccaatgcttgacttaatgtaggtgattacattttttcacttctcatctgaatattttggccttatgtagagacttccttgagtatatgataa

SEQ ID NO: 81488 - DNA, 201 bp, Homo sapiens
ctctttagacttgttcatggtataaccttgtcactccatacttcattttacaatcttttaaaaaaatttgcactctctataatttgctcttagtctttgtsatataacaagggcctcaaagataaaatgctaatttttaatggtgtcatttcaaagttagaattcgggatcagaaatatgtgttttacttaacccccttcc

SEQ ID NO: 81489 - DNA, 201 bp, Homo sapiens
gggtgcctctttagcctcaggagcatagaagtctaggctccccattcagcctttgctgttgtgggttggggaggggcctcaggtttttctgtggtgtttgrctaaaggagagaagtcagtgtccaccagttttctatcatatctcgctatgctgccctttactggtactttggttagagaaagcagattttatttgggctt

SEQ ID NO: 81490 - DNA, 201 bp, Homo sapiens
tgaaaagaagagctggtactatgaaaagaagtcccgaagttcttggagactcacatcctcagaaatgaaaaaatcccatgagtttcacggtattttcctcrgactttgatctaatctcctaattaaatcacactgggtcacagtgatttctgcccttagatattcacaagattagacatgagatgcttctgagacacccag

SEQ ID NO: 81491 - DNA, 201 bp, Homo sapiens
agataaactgcgggtatgcgaaggcagacagattggtataatggacattggagactcaaaagggaacgggggatggatgaaaagctacctattgggtacarggtacactactcaggtgacaggtacactaaaatcctagacttcaccactatacaattcatccatgtaaccaaaaaccacttgcattcctaaagcaactga

SEQ ID NO: 81492 - DNA, 201 bp, Homo sapiens
cagccagacaaacctctctccagaactcagtcagacaaacctttccccagacctcagtgagatgcccctctttgcagatctcagtcaaattccccttaccycagacctcgaccagatgacactttctccagaccttggtgagacagatctttccccaaactttggtcagatgtccctttccccagacctcagccaggtgac

SEQ ID NO: 81493 - DNA, 201 bp, Homo sapiens
taaagtaactaccctctcgcatcaccctctgtaattgaaatgaacatctttcttaagcaaagaaagttattgctaaggaatgacagtgggtcaaagtgggmaagacttggccagaactatttctcctactctgttgacttcttttgggtccaggacaagtgtttctaccattctattgtgatctgtgtacatgtaatgttg

SEQ ID NO: 81494 - DNA, 201 bp, Homo sapiens; identical to SEQ ID NO: 59692

SEQ ID NO: 81495 - DNA, 201 bp, Homo sapiens
acagaagatggcatttatttgaaattttcttgaacaagtattagctatgttctgctctttctttatgaaaagaactgcaaagtcaagactcctttatctgwcattctgcaatgtatatatacttcaaaacaatatgtcatacacagtatatgcatacaattttatctgtcaattaaaaagagaaacaactcctccatttca

SEQ ID NO: 81496 - DNA, 201 bp, Homo sapiens
ttgaatgattggccatgaattagaatgcctacatttacagaagatggcatttatttgaaattttcttgaacaagtattagctatgttctgctctttctttrtgaaaagaactgcaaagtcaagactcctttatctgacattctgcaatgtatatatacttcaaaacaatatgtcatacacagtatatgcatacaattttat

SEQ ID NO: 81497 - DNA, 201 bp, Homo sapiens
caggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacc

SEQ ID NO: 81498 - DNA, 201 bp, Homo sapiens
ggcagaattccaaggagtctgtatttttaacaagcagccttccttctattttgccttctattaaaagtaatggcaaaaaccgcaattatagtttgcaccarcctaacacatgctgcctgaggagttagtgaaggcagcccctcgacagcactttgggtgacgttgtgtgaatctgcctcagatgcagacacagaagtccaa

SEQ ID NO: 81499 - DNA, 201 bp, Homo sapiens
tattggagactcaccaagaaatctttgatgttccagcaatgcatgccatttcagagattcaaaattgtcctcgtgaattattacttagaaacatctaaatrtctcttatttgtggggatagagctcatcaccatccctttaattctaagacaagatgtgctgttaggatatttatgatattaaaagtccattttattcttg

SEQ ID NO: 81500 - DNA, 201 bp, Homo sapiens
aatgagttctacaaaagagagtgctgagtgatacagtagatggcatccttgataaaattcttataaccagcataatagattaaaagttgcataaaataatrgattaaaagttgcattaaaatatttctcattatagctaagatataacagtaaacacaattgaatagaaacaatttttactcattttttaatgtagtctag

SEQ ID NO: 81501 - DNA, 201 bp, Homo sapiens
catagacgatacctatttttttggctttggttacagatgccagaactaattaactttgttaccgtattctttccctcaagtcatacaccagagtaagaccrcctctgacaatacaattttatttacaaaaacaggaaattggttgggtttggcccatgagccactgacatagtgacatagaactagcctgatataggcttc

SEQ ID NO: 81502 - DNA, 201 bp, Homo sapiens
cactaaattgggtacatgctgtgctggcttccccaagccctgaagtaggccactcctttccccaatccagctttgggcactgaggagagggttagaagggytttaggccatctggctgttggaggagctaaagagcagcttgaaaaccatttagccatgtgttttcctacatgcgtgaaagtatttggtatgcatttatga

SEQ ID NO: 81503 - DNA, 201 bp, Homo sapiens; identical to SEQ ID NO: 59700

SEQ ID NO: 81504 - DNA, 201 bp, Homo sapiens; identical to SEQ ID NO: 59702

SEQ ID NO: 81505 - DNA, 201 bp, Homo sapiens
caacaagaataaataaattaaaatgcatggtcacattttaaatgttagcaatagtcaaacatttattggtggccacttcctggcacttactatgcacttaygttgacatacatttttaaatatttacaatgacttctgtgaggtaaaatgttattatccttattttgccaatgaggaaatgaagaatcagagaataagtaa

SEQ ID NO: 81506 - DNA, 201 bp, Homo sapiens
gccaatcagagtgccgacagcatctctgtgaagaaagtgcctggattatatagacacatcacaactctccaaggaagggctctaatttggaattacctccrtcagcccattttcaataagacctacctgagattcaaactaggcctgactcttccaaagtcctcaggtcactcaaacttcaatgtcatgacagtatctggc

SEQ ID NO: 81507 - DNA, 201 bp, Homo sapiens
taaagataattcttcaattaaaatgtgttcaaataatttagtatttatcttaaaacttgttagtttcagaaaaaatcagaaagtaatttttaaatttattrttttctatataaactgttgtcaaactcatacccactaaggtataagtgactgataataggtcaatgaactaccttccttaggagtacttgcattagcact

SEQ ID NO: 81508 - DNA, 201 bp, Homo sapiens; identical to SEQ ID NO: 59705

SEQ ID NO: 81509 - DNA, 201 bp, Homo sapiens
gagacacctaagccaagacactggttctccttccggaatgaggccctgggaggaccttcctagccaagacactggttctccttccagaatgaggccctggraggaccctcctagtgatctgttactcttaaaacaaagtaactcatctaagattttggttgggagatggcatttggcttctgagaaaggtagctatgaaat

SEQ ID NO: 81510 - DNA, 201 bp, Homo sapiens
tctgaagaccctatagaggatcctctacagccagatgtcacagggatacgtctactttcacttggtgctggagaattcaaaagtcaagaacatgctaagcrtaagggacccaaggtagaaagagatcaagcagcaaagcacaggttctcctggatgaaattactagcacataaagttgggagacacctaagccaagacact

SEQ ID NO: 81511 - DNA, 201 bp, Homo sapiens
gcagagcattccagcccatattctgaagaccctatagaggatcctctacagccagatgtcacagggatacgtctactttcacttggtgctggagaattcaraagtcaagaacatgctaagcataagggacccaaggtagaaagagatcaagcagcaaagcacaggttctcctggatgaaattactagcacataaagttggg

SEQ ID NO: 81512 - DNA, 201 bp, Homo sapiens
agtaagttcactgtcaataaccttgcagaacctcagaaagccccttctcaccaacaagccaccacagctggttccccactgagacacctcattggcaagamctcagttctcaattcttccacagcagagcattccagcccatattctgaagaccctatagaggatcctctacagccagatgtcacagggatacgtctactt

SEQ ID NO: 81513 - DNA, 201 bp, Homo sapiens
taggaatcaggtcattccgaaactcatcattgaatcaggaagaagaagagttcaatcttactgccctagctctggagaatggcactgaattcgtttcttcraacacagatataattgttggttcaaattattcttccccaagtaatattagtaagttcactgtcaataaccttgcagaacctcagaaagccccttctcacc

SEQ ID NO: 81514 - DNA, 201 bp, Homo sapiens
tggctgcagcattaggaatcaggtcattccgaaactcatcattgaatcaggaagaagaagagttcaatcttactgccctagctctggagaatggcactgarttcgtttcttcaaacacagatataattgttggttcaaattattcttccccaagtaatattagtaagttcactgtcaataaccttgcagaacctcagaaag

SEQ ID NO: 81515 - DNA, 201 bp, Homo sapiens; identical to SEQ ID NO: 59716

SEQ ID NO: 81516 - DNA, 201 bp, Homo sapiens; identical to SEQ ID NO: 59717

SEQ ID NO: 81517 - DNA, 201 bp, Homo sapiens
tattttgaaataaaaaagatacccactttttatttctctctctgaactcacttagatgaaattacaagtttgactacatagtacgtctccagtgacataawccactgtttgttacaactgggtgctttggaaagaagttaaatgactcacggtagaatcatgacttaagagaaaccaacagataaaattctaaacattatt

SEQ ID NO: 81518 - DNA, 201 bp, Homo sapiens
caataatatgtttgggctattatctaatgctgtgtagaaatattaaaacccctcttattttgaaataaaaaagatacccactttttatttctctctctgawctcacttagatgaaattacaagtttgactacatagtacgtctccagtgacataatccactgtttgttacaactgggtgctttggaaagaagttaaatgac

SEQ ID NO: 81519 - DNA, 201 bp, Homo sapiens
aattgataatgactattaattgatctggaaaatacttgtttggggatcaataatatgtttgggctattatctaatgctgtgtagaaatattaaaacccctsttattttgaaataaaaaagatacccactttttatttctctctctgaactcacttagatgaaattacaagtttgactacatagtacgtctccagtgacata

SEQ ID NO: 81520 - DNA, 201 bp, Homo sapiens
gtttagaacctgaagatgaagagagtgatgctgactatgattaccagaacagactggctgcagcattaggaatcaggtcattccgaaactcatcattgaaycaggaagaagaagagttcaatcttactgccctagctctggagaatggcactgaattcgtttcttcaaacacagatataattgttggttcaaattattctt

SEQ ID NO: 81521 - DNA, 201 bp, Homo sapiens
tcatggctacacggaaaatgcatgatcgtttagaacctgaagatgaagagagtgatgctgactatgattaccagaacagactggctgcagcattaggaatyaggtcattccgaaactcatcattgaatcaggaagaagaagagttcaatcttactgccctagctctggagaatggcactgaattcgtttcttcaaacacag

SEQ ID NO: 81522 - DNA, 201 bp, Homo sapiens
aaaagatgaatttcttatattatgcttttcctccaagtggaattattagaatatctttaaaggcagagaatggagcacaaaatatttactatacatttgaygaatgactaaatcaatgtaaatggaaggctttatctttttcctgagatttctcctttggctaatttaggagaataatctctcatttgaaaattctgagtt

SEQ ID NO: 81523 - DNA, 201 bp, Homo sapiens
cagaaaattactctcagctttctttgcataacttccttttggcagtgaatctatcatagttctagaccagtgctgtccaatagaaactacgtatgagctayatgcgtaatttaaaattttctgatagcaacattaaaaagtaaagagaaataggtgacattaattttagtaatatgttttacttaactcagtatatcctga

SEQ ID NO: 81524 - DNA, 201 bp, Homo sapiens
gtgaggacagtggacccacccatgatgaccctccatgcctcacacacatctattactcccatgaaaatctgatcgaggatttcaactcggggctgattggscccctgcttatctgtaaaaaaggtaagaacacccccaccaaaagattcaacaactaaatgttggaatggtcaggagttctgtcatgggacaaagcttggg

SEQ ID NO: 81525 - DNA, 201 bp, Homo sapiens
aatagtggcaagagagcatttgggtggtcacactgggaaaagtgtgcctatttggaaattcacaaggaaaatttgccctgtaagctagtaactgaaacagraactgagaagagaaaggtacgagcttgtgttatgaatatgtagataggtgttctcacgcctgatataatttgaaggatgcccaaatgatctcaacccgtc

SEQ ID NO: 81526 - DNA, 201 bp, Homo sapiens
tataatcagatatatttaagtcagggccacacaaggtaggtaaaaatatctaattattgagtcagaaacataatccctaaccatggagttttactttattrtatatattttctaagcaaaaattattcattttttttctgtttttcatagactgtaggatgccaatgggactaagcactggtatcatatctgattcacaga

SEQ ID NO: 81527 - DNA, 201 bp, Homo sapiens
tccagggcattgtcatctgaacccacttagactttgtatatagcacctgttgtctccagatttgtagtgtggatgcccatgtgcatgtctgtttcagcagkagcttaaaagcttcttatgaacaagaatcaagcttctttcatcttcacatctccactacctatcactctcatttcattagtagataatgtcagtacttta

SEQ ID NO: 81528 - DNA, 201 bp, Homo sapiens
acacgccccaacgcctggctaatttttgtatttttttgtagagatgaggtttcaccatgttgcccaggctggtcttgaactcctgagctcaagtgatccamctgcttcagcctcccaaagtgctggggttacaggtttgagccactgaacctagctgagaagatgacttcaaagacagtgtcctaaaaaatctaccgggca

SEQ ID NO: 81529 - DNA, 201 bp, Homo sapiens
gatacttgtacagagtcttgagagtcaccaaatgttttcttcccaagctggatgaaataaagcctgttccccaaagcaagaaggtatcaaagaagacagtrtggcaccagattttaaataaccctagaaccattattacttgataaatatgctattttaaaaaataagaatttcttcaagttgaaatcattatggttgatt

SEQ ID NO: 81530 - DNA, 201 bp, Homo sapiens; identical to SEQ ID NO: 59733

SEQ ID NO: 81531 - DNA, 201 bp, Homo sapiens
gccccctttcatatacaaataagatgacagcattaaacttggggcatgatgcttttaccaactgagctaacgtatctatatactcttctattgagactggrggaaatggatacttgtacagagtcttgagagtcaccaaatgttttcttcccaagctggatgaaataaagcctgttccccaaagcaagaaggtatcaaaga

SEQ ID NO: 81532 - DNA, 201 bp, Homo sapiens
gataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcggggttatt

SEQ ID NO: 81533 - DNA, 201 bp, Homo sapiens
tagtgagaatggattaatgctgatacttccacccaattatctaatgccccctttcatatacaaataagatgacagcattaaacttggggcatgatgctttyaccaactgagctaacgtatctatatactcttctattgagactgggggaaatggatacttgtacagagtcttgagagtcaccaaatgttttcttcccaagc

SEQ ID NO: 81534 - DNA, 201 bp, Homo sapiens
ctacagccagcaattatttatgagcaattgcttaaaatgctcccacagctttcactggagacatgattattggcatataatattgcctctggtcctatgamtctaagaaaggtaaatacatattggtagggaaagtaaaattttaccttggaaatgagatgcaaacctagtaagcagatagtatcttttatggtaaaagac

SEQ ID NO: 81535 - DNA, 201 bp, Homo sapiens
ttttcaagaatattctcccattccaaaggttgtctcttcactctgttatttcctttgctgtgcataaacttttgagtttgatggcaatcccatttgtctayttctgcttttgttgcctgtactttcgaggtcaaatccaaaaaatctttgtccacaccaatgtcaagaagcttaagaataatggacattagcaaaaaacaa

SEQ ID NO: 81536 - DNA, 201 bp, Homo sapiens
ctccagcctaggagacagagcgagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagac

SEQ ID NO: 81537 - DNA, 201 bp, Homo sapiens
attgcaattctgatgcctaggataatataggcacttgatattcattgaataaataaaggaatgaataaaggaatgaatacaaggtggaggtgtagtataawgaagtggcttaaaagtcacgatctagagacagacatattaaactttaaatcatgatgctgtgtgatattaggcaagatatttaaactctctgaggctcag

SEQ ID NO: 81538 - DNA, 201 bp, Homo sapiens
acatagatgacactcaataagtggtatttggtggtggtgagactagaagcattaatagtattagacttttggacatagtgaagtggttaagaaagtaagcyttaaaggcagacaagttaaaattctagctttatcatttctgattctacgactttagcatctctgagcctcagttttctcatctataaaatggaaatgatt

SEQ ID NO: 81539 - DNA, 201 bp, Homo sapiens
gacctctgtcccagaaatcagagtttaccattgcttctgtaaccagttactgcaaacttagtggctaaaacaacacaaatttattcttttatgattatatwtctgcagatgagaagtccaaaatgggttttattgggctaaaatcaaggtgttggcagagctgcattccttctggaggctctgggggagaattgtttcctt

SEQ ID NO: 81540 - DNA, 201 bp, Homo sapiens
gccagaactaattaactttgttaccgtattctttccctcaagtcatacaccagagtaagaccgcctctgacaatacaattttatttacaaaaacaggaaaktggttgggtttggcccatgagccactgacatagtgacatagaactagcctgatataggcttcctggcacatagatgacactcaataagtggtatttggtg

SEQ ID NO: 81541 - DNA, 201 bp, Homo sapiens; identical to SEQ ID NO: 59737

SEQ ID NO: 81542 - DNA, 201 bp, Homo sapiens; identical to SEQ ID NO: 59738

SEQ ID NO: 81543 - DNA, 201 bp, Homo sapiens
acaggacagggattttcacagtgcttttctatacaatgtctgtaatctatagataacataaccgattaggtcacgggtcgatctttaactaccaggtccakggtgtggcgccgggctgtctgcttgtggatttcatttctgccttttagtttttacttcttctttctttggaggcagaaattgggcataagacaatatgag

SEQ ID NO: 81544 - DNA, 201 bp, Homo sapiens
caaccataatttcttctcttgagttatttcattgtctttctgtcctaactcagctgggatgcaggcttacattgacattaaaaactgcccaaagaaaaccrggaatcttaagaaaataactcgtgagcagaggcggcacatgaagaggtgggaatacttcattgctgcagaggaagtcatttgggactatgcacctgtaat

SEQ ID NO: 81545 - DNA, 201 bp, Homo sapiens
tgatggcaataatcataaagataatagtcatgcaagttattgtatcagccgctgaatagtaagtacctgatgttaatatggttctaattatcccattatgmtgatgttcagatcattgtaagcatagtagagttccatcaggcactggtataaaaaattgtatccatattataatagttgttggtatgagaacattttaaa

SEQ ID NO: 81546 - DNA, 201 bp, Homo sapiens
agtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttact

SEQ ID NO: 81547 - DNA, 201 bp, Homo sapiens; identical to SEQ ID NO: 59741

SEQ ID NO: 81548 - DNA, 201 bp, Homo sapiens
aacagatattgaagactctgatgatattccagaagataccacatataagaaagtagtttttcgaaagtacctcgacagcacttttaccaaacgtgatcctygaggggagtatgaagagcatctcggaattcttggtcctattatcagagctgaagtggatgatgttatccaagtaagtcttttgagcactgctaagatctt

SEQ ID NO: 81549 - DNA, 201 bp, Homo sapiens
tttaaaactgttgagattagagttcatataaatggagactaaaatctaaggaaatgatatcacaataggaaatcattttgttaccaaaataatgtataagmaacacatataaggaagagatacttcatgagatcatttctgtttcttttcacacgagtagtcaaaattatatttgaagtaataaaaccatcatgatatccg

SEQ ID NO: 81550 - DNA, 201 bp, Homo sapiens
atatatacaatagccataatttttaaagaaaatctcttattttttcctcatctcttcctttatcaagaagactgggttgaatagggttctaatatcttaaytatgataccatattccgcagggatgatagagaccatcaagggagaacttcctccagttgaatccccttgtcagtaattcacctgtccctttccccaatca

SEQ ID NO: 81551 - DNA, 201 bp, Homo sapiens; identical to SEQ ID NO: 59743

SEQ ID NO: 81552 - DNA, 201 bp, Homo sapiens
aattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgaccctcttccccat

SEQ ID NO: 81553 - DNA, 201 bp, Homo sapiens
acccctgggtatggaaaatggaaagatagaaaacaagcaaatcacagcttcttcgtttaagaaatcttggtggggagattactgggaacccttccgtgccygtctgaatgcccagggacgtgtgaatgcctggcaagccaaggtcaagtatactctatgcatggtgttctcttagggctccagaagaaagcaaaggccctc

SEQ ID NO: 81554 - DNA, 201 bp, Homo sapiens; identical to SEQ ID NO: 59745

SEQ ID NO: 81555 - DNA, 201 bp, Homo sapiens; identical to SEQ ID NO: 59749

SEQ ID NO: 81556 - DNA, 201 bp, Homo sapiens
acggaaaatgcatgatcgtttagaacctgaagatgaagagagtgatgctgactatgattaccagaacagactggctgcagcattaggaatcaggtcattcygaaactcatcattgaatcaggaagaagaagagttcaatcttactgccctagctctggagaatggcactgaattcgtttcttcaaacacagatataattgt

SEQ ID NO: 81557 - DNA, 201 bp, Homo sapiens
tggagtccaaagatatttaggagctaaagttgattaaacttggtgactcattagatgcagataatgaggaagaaaagggaattgttatggacttcaaggtktctggtttgaacagcagaatggatagggtgccattcagtgagaaagaaaatgtaagaaaaggagatagtttgtgagagaaggtgataagtatagatttgg

SEQ ID NO: 81558 - DNA, 201 bp, Homo sapiens
ctggaagaggggggtcagtcagtggagtccgacatgtcaggagtcaaaagaggtgtagacatctggactattctataaagatgggggcctgagcctgcccygtggaaggaatagggagagctttggctcaggagtccagagatctgagttctgatcccagcaatgctaccagatcactgactgaccttgggcaagtcacct

SEQ ID NO: 81559 - DNA, 201 bp, Homo sapiens
cagagggtagcagctggaagaggggggtcagtcagtggagtccgacatgtcaggagtcaaaagaggtgtagacatctggactattctataaagatgggggyctgagcctgccccgtggaaggaatagggagagctttggctcaggagtccagagatctgagttctgatcccagcaatgctaccagatcactgactgacctt

SEQ ID NO: 81560 - DNA, 201 bp, Homo sapiens; identical to SEQ ID NO: 59769

SEQ ID NO: 81561 - DNA, 201 bp, Homo sapiens
tgggtatggaaaatggaaagatagaaaacaagcaaatcacagcttcttcgtttaagaaatcttggtggggagattactgggaacccttccgtgcccgtctraatgcccagggacgtgtgaatgcctggcaagccaaggtcaagtatactctatgcatggtgttctcttagggctccagaagaaagcaaaggccctcactac

SEQ ID NO: 81562 - DNA, 201 bp, Homo sapiens
tcctatctatgaatcagtttttctctttatgcttttctctacgacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctggg

SEQ ID NO: 81563 - DNA, 201 bp, Homo sapiens
ctcaatacacttggtgagtgaatgtttgatcacagagtacttgactgaatgcttattttggcctgtgtctctccctctttctcagatataacagtttgtgyccatgaccacatcagctggcatctgctgggaatgagctcggggccagaattattctccattcatttcaacggccaggtcctggagcagaaccatcataag

SEQ ID NO: 81564 - DNA, 201 bp, Homo sapiens
aggattacaggcatgagccactgcacctggccatggatggtacctaatgttgtaaaatagcataatttaagataaaagcagaagaaaatcagtttaaaaartgattacatttcaggatttcagttgctttcttctaggatgccactatatctattaaagcaccagtcttgttagtgcatttaccattttataatcagatat

SEQ ID NO: 81565 - DNA, 201 bp, Homo sapiens
ctcggcctcccagagtgctaggattacaggcatgagccactgcacctggccatggatggtacctaatgttgtaaaatagcataatttaagataaaagcagragaaaatcagtttaaaaaatgattacatttcaggatttcagttgctttcttctaggatgccactatatctattaaagcaccagtcttgttagtgcattta

SEQ ID NO: 81566 - DNA, 201 bp, Homo sapiens
atgttcatgagtacccaatgtttagctcccacttataagtgagaacatgtggtatttggctttctgtttctgcattaattcacttagcataatagcctccrgctggcatccatgttgttgcaaaggacgtgatttcagtctttgttatggctgcgtagtattccatggtgcatatgtaccatattttctttatgtagtcca

SEQ ID NO: 81567 - DNA, 201 bp, Homo sapiens
gacaattctccttaaatgtcatgtcacttcaccaagatagataagaattggacagcagagaattaaaggttgcaatctttgacaaaatcctagagtgtagwtaatctacagacaaaggatgatccaaaggctttgacaatcaaccaaatagaagataggattaaggttctcttttgcagattaaagagcctaactaggact

SEQ ID NO: 81568 - DNA, 201 bp, Homo sapiens
tctaaatgcagttgttcctgctcaaagagacctctggccaaactggcaagcagttaaagttttctttcagggccttcctctctatggcctcaacttcctcytctctcttcttccagcaacttcccctttcatcattcctttccctggggacttggcattcagtgatcctgtagatattgcacaactggggaacctttagac

SEQ ID NO: 81569 - DNA, 201 bp, Homo sapiens; identical to SEQ ID NO: 59785

SEQ ID NO: 81570 - DNA, 201 bp, Homo sapiens
tcagccatacaaccctttctccagacctcagccatacaaccctttctttagacctcagccagacaaacctctctccagaactcagtcagacaaacctttcyccagccctcggtcagatgcccctttctccagacctcagccatacaaccctttctctagacttcagccagacaaacctctctccagaactcagccatatga

SEQ ID NO: 81571 - DNA, 201 bp, Homo sapiens
atgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgacc

SEQ ID NO: 81572 - DNA, 201 bp, Homo sapiens
gaactttttttcatatttttatattttgtatttttattttttttgtagagaagaggttgcccaagatcaaactcctggcctcaagtaatcctcccccctcrgcctcccagagtgctaggattacaggcatgagccactgcacctggccatggatggtacctaatgttgtaaaatagcataatttaagataaaagcagaaga

SEQ ID NO: 81573 - DNA, 201 bp, Homo sapiens
tttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcatt

SEQ ID NO: 81574 - DNA, 201 bp, Homo sapiens
agaactttttttcatatttttatattttgtatttttattttttttgtagagaagaggttgcccaagatcaaactcctggcctcaagtaatcctcccccctyggcctcccagagtgctaggattacaggcatgagccactgcacctggccatggatggtacctaatgttgtaaaatagcataatttaagataaaagcagaag

SEQ ID NO: 81575 - DNA, 201 bp, Homo sapiens
atagtttgcaccaacctaacacatgctgcctgaggagttagtgaaggcagcccctcgacagcactttgggtgacgttgtgtgaatctgcctcagatgcagrcacagaagtccaaatggactggtttgattaagagcagggaaaaaaagagggttcttattggtttttcacatgccagtaactcactaatacatctagagag

SEQ ID NO: 81576 - DNA, 201 bp, Homo sapiens
gtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagct

SEQ ID NO: 81577 - DNA, 201 bp, Homo sapiens
tgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttgctattgtgaagagtgcgaaaatgaacatacgcatg

SEQ ID NO: 81578 - DNA, 201 bp, Homo sapiens
aaccataatttcttctcttgagttatttcattgtctttctgtcctaactcagctgggatgcaggcttacattgacattaaaaactgcccaaagaaaaccasgaatcttaagaaaataactcgtgagcagaggcggcacatgaagaggtgggaatacttcattgctgcagaggaagtcatttgggactatgcacctgtaata

SEQ ID NO: 81579 - DNA, 201 bp, Homo sapiens
gccaagacagagggtagcagctggaagaggggggtcagtcagtggagtccgacatgtcaggagtcaaaagaggtgtagacatctggactattctataaagrtgggggcctgagcctgccccgtggaaggaatagggagagctttggctcaggagtccagagatctgagttctgatcccagcaatgctaccagatcactgac

SEQ ID NO: 81580 - DNA, 201 bp, Homo sapiens
tcttggcctaatcctttagcaatccctgtgtttttgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacaca

SEQ ID NO: 81581 - DNA, 201 bp, Homo sapiens
catgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactg

SEQ ID NO: 81582 - DNA, 201 bp, Homo sapiens
ctctctccagaactcagccatatgactctctctccagaactcagtcagacaaacctttccccagccctcggtcagatgcccatttctccagacctcagccrtacaaccctttctctagacttcagccagacaaacctctctccagaactcagtcaaacaaacctttccccagccctcggtcagatgcccctttctccagac

SEQ ID NO: 81583 - DNA, 201 bp, Homo sapiens
tcctctctattcccttccccaaagaagtctgaatgcaaggagtctgcctgccattattataccaataaccttgagtctgtttctgcttatattttatatamaattatttactgtttattagttacctatttttaataattatttatactatgtctcagaaccattgaaatcctaaattatggttcttactaatcagtatta

SEQ ID NO: 81584 - DNA, 201 bp, Homo sapiens
ccagtaattagaacagaacagaacaggacagggattttcacagtgcttttctatacaatgtctgtaatctatagataacataaccgattaggtcacgggtmgatctttaactaccaggtccagggtgtggcgccgggctgtctgcttgtggatttcatttctgccttttagtttttacttcttctttctttggaggcagaa

SEQ ID NO: 81585 - DNA, 201 bp, Homo sapiens; identical to SEQ ID NO: 59799

SEQ ID NO: 81586 - DNA, 201 bp, Homo sapiens
tttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcag

SEQ ID NO: 81587 - DNA, 201 bp, Homo sapiens
atgagaacaaagagacaacataccagaatctctaggagacagggctttgcttttgctgcattctattcgttgtgaacacaaattacaggccagtctcgatwcagtgtagaagggaactgcataaggaccacataccaggaggcataattcactgggagcatctttagaaactaccagagttacctgttgcccataccagtg

SEQ ID NO: 81588 - DNA, 201 bp, Homo sapiens
aagaatggttctgccaatcagagtgccgacagcatctctgtgaagaaagtgcctggattatatagacacatcacaactctccaaggaagggctctaatttsgaattacctccatcagcccattttcaataagacctacctgagattcaaactaggcctgactcttccaaagtcctcaggtcactcaaacttcaatgtcatg

SEQ ID NO: 81589 - DNA, 201 bp, Homo sapiens
atttggcaagactctgggtgaggtagtgggaacaggagtttctcctatgttcttaaaatcatacagtgacatagtgaacaaccacttcacctacttatgargcttctagacgactgcatcagaagttcagcaatgtaaagaagaagggggagaaacctcaaaatatcaaaatgtcacatgcaggtttcatttcaaataagg

SEQ ID NO: 81590 - DNA, 201 bp, Homo sapiens
tttctgattctacgactttagcatctctgagcctcagttttctcatctataaaatggaaatgattataaccacccataagattgcctgaaatttaaatgargtcacttaggtagagtactaaacatggttcctgggatcggataagctctctataaataatgatgacaatgatggcaataatcataaagataatagtcatg

SEQ ID NO: 81591 - DNA, 201 bp, Homo sapiens; identical to SEQ ID NO: 59808

SEQ ID NO: 81592 - DNA, 201 bp, Homo sapiens
ctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggcaggggaaaagtggttcatgtttc

SEQ ID NO: 81593 - DNA, 201 bp, Homo sapiens
tcaaaaaaagaggatgcaaacactctgtatgtactaatacaaaaagttctccaagatatgttattaaattaaaaagctgggatgtagtatagcgtgtatayatagctgccttttgttaaaggagtgaaagggataagaatatttatattttcttatttgtaagacataaaggtattctggaattacacgcatgaaattaat

SEQ ID NO: 81594 - DNA, 201 bp, Homo sapiens
tttaataaattaggatacattcatacaatggaatactaagcatcaaaaaaagaggatgcaaacactctgtatgtactaatacaaaaagttctccaagataygttattaaattaaaaagctgggatgtagtatagcgtgtatacatagctgccttttgttaaaggagtgaaagggataagaatatttatattttcttatttg

SEQ ID NO: 81595 - DNA, 201 bp, Homo sapiens
tggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgt

SEQ ID NO: 81596 - DNA, 201 bp, Homo sapiens
cagtcttgcttctcaatgcagaatcctttcttcccatgcactaactccctctttctcccttgccctttcaagccacctgcaccgcagacaaactttcctcrgttcctaacaaccaaacttagatattttgctcttagatttataacttgctctttggggatggagaaagcgaaggaattggcaaaggtttttttttttttt

SEQ ID NO: 81597 - DNA, 201 bp, Homo sapiens
caggaacaacaccatgatcagagcagttcaaccaggggaaacctatacttataagtggaacatcttagagtttgatgaacccacagaaaatgatgcccagkgcttaacaagaccatactacagtgacgtggacatcatgagagacatcgcctctgggctaataggactacttctaatctgtaagagcagatccctggacag

SEQ ID NO: 81598 - DNA, 201 bp, Homo sapiens
cttttattttagattcagggggcatatgtgcagttttgttatctgggtatattatgtgatgctgttgtttagggtatgattgatcccatcatccaagtagmgtgcatagtacccaatagtttttcatcccttgctcatctccttccttcccccttctagaagtccccagtgtttattgccatctttatgttcatgagtacc

SEQ ID NO: 81599 - DNA, 201 bp, Homo sapiens
accctctcgcatcaccctctgtaattgaaatgaacatctttcttaagcaaagaaagttattgctaaggaatgacagtgggtcaaagtgggcaagacttggycagaactatttctcctactctgttgacttcttttgggtccaggacaagtgtttctaccattctattgtgatctgtgtacatgtaatgttgagttaatgag

SEQ ID NO: 81600 - DNA, 201 bp, Homo sapiens; identical to SEQ ID NO: 59810

SEQ ID NO: 81601 - DNA, 201 bp, Homo sapiens
catattttaaatatatgagttgcatatgaatgtgatgtcacaaaattagttctataatatatagccatctgctggtaagccagctctccaaataaaacacrttttctgccagacattgttcgttgtatctaagtgttgccaaattctctatacaaaaatttgctcttctagatttttccaaaacattccaatgcttgactt

SEQ ID NO: 81602 - DNA, 201 bp, Homo sapiens
ctttaaaaagcttgtttcatggagaatttaatattattcttttcttttagttatattctcatattttaaatatatgagttgcatatgaatgtgatgtcacmaaattagttctataatatatagccatctgctggtaagccagctctccaaataaaacacgttttctgccagacattgttcgttgtatctaagtgttgccaa

SEQ ID NO: 81603 - DNA, 201 bp, Homo sapiens
agcttcttatgaacaagaatcaagcttctttcatcttcacatctccactacctatcactctcatttcattagtagataatgtcagtactttagccttgagyctaagaacaaatatcttttggtatttctggagaaaactacttgggccatatctcacaggatggttatgaaaattaaatgaaataatatacataagttatt

SEQ ID NO: 81604 - DNA, 201 bp, Homo sapiens
ttggtgagtaagagtctggacactcacagaggaagcttgctttgaatttctggtctataaaggtctgctgcaactctccaggctaccagtgctcctctatktatctccctgaccccctgcaggcttttctttcaatgtttctcatgatttctctttgagaaattaatgacttaaatggatccagttctttagtgtgggtta

SEQ ID NO: 81605 - DNA, 201 bp, Homo sapiens; identical to SEQ ID NO: 59811

SEQ ID NO: 81606 - DNA, 201 bp, Homo sapiens
ttcgttgtatctaagtgttgccaaattctctatacaaaaatttgctcttctagatttttccaaaacattccaatgcttgacttaatgtaggtgattacatyttttcacttctcatctgaatattttggccttatgtagagacttccttgagtatatgataaacacctgaaacaaactataacggctatagtttgtatattt

SEQ ID NO: 81607 - DNA, 201 bp, Homo sapiens
taatattttgcccatatctcagcagtcgctcctatcatacatctatctccaaactagcttgtgagttccttcagtacagggactgtatttgatccaggtakccagaaactttctaacacagtgcctggcatgtagaaagtaaaacctcattcttgatttctgcacccataacctcctgtctctgctgtgttctcccattgc

SEQ ID NO: 81608 - DNA, 201 bp, Homo sapiens
actaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgctt

SEQ ID NO: 81609 - DNA, 201 bp, Homo sapiens
ggagttttagaccagcctgggcaatgtagtgagactctgtttctatttaaaaaaatacatacatatatatatatatatatatatatatatatatatatatwtaaattagccagacatggtggtacatacctgtcatttcagctactggggaggctaaggcaagagggtcatttaggacaagagcatcacttgagcccagga

SEQ ID NO: 81610 - DNA, 201 bp, Homo sapiens
aggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccagg

SEQ ID NO: 81611 - DNA, 201 bp, Homo sapiens
caggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccag

SEQ ID NO: 81612 - DNA, 201 bp, Homo sapiens
tggaggaactgccatactgtcttccacaatggctgaattaatttacattccaccaagagtgtataagtgttcctttctctccatgaccttgccagcatctsttctttcttgacttttcaatcatcgccattctgactggcatgagagggcatctcattgcgtttttctttctttttttgagacggagtctcgctctgtcgc

SEQ ID NO: 81613 - DNA, 201 bp, Homo sapiens
agtaatattcagtggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaa

SEQ ID NO: 81614 - DNA, 201 bp, Homo sapiens
gccaggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagccc

SEQ ID NO: 81615 - DNA, 201 bp, Homo sapiens
tatgaggccatgtagcaagaagcattgaagaagggctgtcatgcttgattcaaggtagatggtgcagctcatcaactagccatgctaatttcagttaatasacaagttctgacctgagagggcaactctccttatcagtcctgtttgtgctttgttaccaaagctcttttgtaatctttcacagataatgcttcctgctta

SEQ ID NO: 81616 - DNA, 201 bp, Homo sapiens
aataattcaaacagaaaattactctcagctttctttgcataacttccttttggcagtgaatctatcatagttctagaccagtgctgtccaatagaaactaygtatgagctacatgcgtaatttaaaattttctgatagcaacattaaaaagtaaagagaaataggtgacattaattttagtaatatgttttacttaactca

SEQ ID NO: 81617 - DNA, 201 bp, Homo sapiens
aactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaa

SEQ ID NO: 81618 - DNA, 201 bp, Homo sapiens
ctttgggagatttttttttattatactttaagttttagggtacatgtgcacattgtgcaggttagttacatatgtatacatgtgccatgctggtgcgctgyacccactaactcgtcatctagcattaggtatatctcccaatgctatccctcccccctcctttgggagatttttaggtaatgaggatggagccctcatgat

SEQ ID NO: 81619 - DNA, 201 bp, Homo sapiens
ttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaa

SEQ ID NO: 81620 - DNA, 201 bp, Homo sapiens
ctttcttaagcaaagaaagttattgctaaggaatgacagtgggtcaaagtgggcaagacttggccagaactatttctcctactctgttgacttcttttggstccaggacaagtgtttctaccattctattgtgatctgtgtacatgtaatgttgagttaatgagctgctaaaaccttctagattgaaaataagtgagtcag

SEQ ID NO: 81621 - DNA, 201 bp, Homo sapiens
tctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcagttcctaacaaccaaacttagatattttgctcttagatttataacttgctctttgggg

SEQ ID NO: 81622 - DNA, 201 bp, Homo sapiens
cagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaaaggcgattcaattctctgattatatttaaataataattgttcaggta

SEQ ID NO: 81623 - DNA, 201 bp, Homo sapiens
ataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattca

SEQ ID NO: 81624 - DNA, 201 bp, Homo sapiens
ccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaag

SEQ ID NO: 81625 - DNA, 201 bp, Homo sapiens
gatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaatt

SEQ ID NO: 81626 - DNA, 201 bp, Homo sapiens
ttaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcca

SEQ ID NO: 81627 - DNA, 201 bp, Homo sapiens
cattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattc

SEQ ID NO: 81628 - DNA, 201 bp, Homo sapiens
ataaatatataaaattttatcaacgaaattcataacaatctctcagaccacagagaaatcaaattagaactgaggactaagaaactcactcgaaaccacayaactacatggaaactgaacaacctgctcctgaatgactactgggtaaataatgaaattaaggcagaaataaataagttccttaaaaccaatgagaacaaa

SEQ ID NO: 81629 - DNA, 201 bp, Homo sapiens
agacctcagccagacaaacctctctccagaactcagtcagacaaacctttctccagccctcggtcagatgcccctttctccagacctcagccatacaaccmtttctctagacttcagccagacaaacctctctccagaactcagccatatgactctctctccagaactcagtcagacaaacctttccccagccctcggtca

SEQ ID NO: 81630 - DNA, 201 bp, Homo sapiens
tccttattttaagagctttgtgatattccttgaggcaactagaagcatagtaaaatgttgcaaaaccagagttataaaatcagtgatctaagttaaacaawcaccttccagagagttatactgtccctgatattagcccactgagtaattcaggtgatttaatttgggggtaactcttaatatttgactcatttttattaa

SEQ ID NO: 81631 - DNA, 201 bp, Homo sapiens
gaagtcacaagtccttccccacagatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtc

SEQ ID NO: 81632 - DNA, 201 bp, Homo sapiens
taccctagaacttaaagtataatttaaaaaaaataaaaataaaagaattccttttgcaatattaattggttccagcgaaagcttatttatttatttattaycatgaaataactttgcaaatgaaaacaattttgaatatattttctttcaggcaggaacaacaccatgatcagagcagttcaaccaggggaaacctatact

SEQ ID NO: 81633 - DNA, 201 bp, Homo sapiens
gatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaat

SEQ ID NO: 81634 - DNA, 201 bp, Homo sapiens
tcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgct

SEQ ID NO: 81635 - DNA, 201 bp, Homo sapiens
gtagccctagaagaaatctagaggtcaaacctatcacaattagggcaccaacatgtaccctagagttaactaggcagagcccctcaggggcccaggccctktcttctttacatttgtactctggcatttagcacagagcctggaacctagtggatgatgatggtcatgatcatgatgatattaatcattactgaactaaac

SEQ ID NO: 81636 - DNA, 201 bp, Homo sapiens
ccaggctggtctcaaactcctgacctcgggcaatctgcctgcctcagcttcccaaagtgctgggattacaggcatgagccattgcgcccggctgaacaatktattttcttttttggctatatacccagtaatagaattgctaggtcaaattgtagcaggacaagccacagacaaaaacccctcagacaccaagttaaagaa

SEQ ID NO: 81637 - DNA, 201 bp, Homo sapiens
tctggaattacacgcatgaaattaatatatggctacctagaaaattcagggagggtagggaggtcattttgagagtcatcagagaaaagtgagagttttcwctgtaataaaaattatgtgaatgtattttctattaaaaacaattaaactaggaaaaagaacaaaaaaaatttggccaagattatagaattgttgacagaa

SEQ ID NO: 81638 - DNA, 201 bp, Homo sapiens
taggcaaacaacaataagcagtggctagaaattgatctactcaagatcaagaagataacggcaattataacacagggctgcaagtctctgtcctctgaaaygtatgtaaagagctataccatccactacagtgagcagggagtggaatggaaaccatacaggctgaaatcctccatggtggacaaggtagagtggcatctg

SEQ ID NO: 81639 - DNA, 201 bp, Homo sapiens
tgtctttcccagaatcatcctagtctgtcctgcctcttctgatctcctttaatcttcaatatttagtcaatgggagtcttcctttcagttaaaaatcaacractaaaccaaaaccaaatcaaaccatgtccagttaactcctatctagaaaaagaaaaaaaaaaatctccccttgaccctgcctgccttttccttttctct

SEQ ID NO: 81640 - DNA, 201 bp, Homo sapiens
ctagtagtaatagtaatttagaaatatcttcaggtgttttcctaaaaattaaataaaatgaagttaaataaaatgagtaaggaaagtaaagatgtctccaygccctccaaaagtgagcaagtttcttcagtgtcttcctagttctggtaatttctttcaaaatcttgtgtccagacccacgattataacttgcttttataa

SEQ ID NO: 81641 - DNA, 201 bp, Homo sapiens
aatgagcatagatgtgccttcgcaaaatgatattttgcttccatttggctccctagattcattcaaaggaactatgtatggctgactcttttgcatctctktcccgtctattcttctgtttatttagtgtgatatatacaatagccataatttttaaagaaaatctcttattttttcctcatctcttcctttatcaagaag

SEQ ID NO: 81642 - DNA, 201 bp, Homo sapiens
tatgatgaccatggcttcttcaaggacaagccctagcaggaaggatcagcaggaagattgcagtaaagatgaacagattaggagtaatcctcaacacacamaaaaaaccagcatttcaaaaggtgacagaagagtaatattcagtggcatctagaatattttctctttccatttgcatttgggcacttatgagaaggcaaa

SEQ ID NO: 81643 - DNA, 201 bp, Homo sapiens; identical to SEQ ID NO: 59838

SEQ ID NO: 81644 - DNA, 201 bp, Homo sapiens
gcacaaagtacaaagtaagacatctaagtttcaggggatggacacatttcatattcatacagacaaccagcctgcataggggagttagacgctgtggctckggggaaaaaattgagataatcagatggctaagatgaaataaagagataaaacaaagctgaggatcacagcagttggaaagaagatctgaaatagcaaaac

SEQ ID NO: 81645 - DNA, 201 bp, Homo sapiens
gggtttcaccatgttggctaggctggtctcgaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaat

SEQ ID NO: 81646 - DNA, 201 bp, Homo sapiens
ctcttgagtagctgggattacaggcgcccgccaccacccccatgtaatttttgtattttttagtagagacagggtttcaccatgttggctaggctggtctygaactcctgacctaaggtgttccacctgcctcagcctcccaaagtgctggtattacaggtgtgagccactgtgcccggctcttttgggatattttaatct

SEQ ID NO: 81647 - DNA, 201 bp, Homo sapiens
ttgggcctactactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcag

SEQ ID NO: 81648 - DNA, 201 bp, Homo sapiens
attacattgctgctgaagaaatatcctgggattattcagaatttgtacaaaggtttggccagttttctccttttttattctcatttttccattactgctgmaaaaagtagctactacaattcagggggataattgtgggcaaattatactaagaacagtgtggttcccctattgcaagttggcctgttctttttcctttgt

SEQ ID NO: 81649 - DNA, 201 bp, Homo sapiens
gagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttttgagttcacatccaccatctctaagctctgttgttacctgta

SEQ ID NO: 81650 - DNA, 201 bp, Homo sapiens
caggggcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatc

SEQ ID NO: 81651 - DNA, 201 bp, Homo sapiens
gagagcagtggcaccattttagatcactgcaacctctgcctcctgggttcaagtgattctcctgcctcagtctcttgagtagctgggattacaggcgcccrccaccacccccatgtaatttttgtattttttagtagagacagggtttcaccatgttggctaggctggtctcgaactcctgacctaaggtgttccacctgc

SEQ ID NO: 81652 - DNA, 201 bp, Homo sapiens
ggacagcccagaagaatctcatctcaagattcttaatcatagatacacagtcccttttgccatataaagtagcatatttccaggtcccagagattaggacrtggacatctcagcaggggcacattattctgcctactacacccaccaaacaaagccctcccacggtgtcctccatctcagagaatggcaccctcctccacc

SEQ ID NO: 81653 - DNA, 201 bp, Homo sapiens
gggggagggatagcattaggagatatacctaatgttaatgacaagttaatgggtgcagcacaccaacatgacacatgtatacatatgtaacaaacctgcaygttgtgcacatgtaccctagaacttaaagtataatttaaaaaaaataaaaataaaagaattccttttgcaatattaattggttccagcgaaagcttattt

SEQ ID NO: 81654 - DNA, 201 bp, Homo sapiens
caaagtaactcatctaagattttggttgggagatggcatttggcttctgagaaaggtagctatgaaataatccaagatactgatgaagacacagctgttarcaattggctgatcagcccccagaatgcctcacgtgcttggggagaaagcacccctcttgccaacaagcctggaaagcagagtggccacccaaagtttcct

SEQ ID NO: 81655 - DNA, 201 bp, Homo sapiens
cacgagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttag

SEQ ID NO: 81656 - DNA, 201 bp, Homo sapiens
ccccccaccaagggtcttactctgtcacccaggctggagtgcagtggtgtgatcatggctcactgcaacctccacttcctgggctcaggcgattctcgcayctcagcctctcaagtagctgggactacaggcacacgccccaacgcctggctaatttttgtatttttttgtagagatgaggtttcaccatgttgcccaggc

SEQ ID NO: 81657 - DNA, 201 bp, Homo sapiens
ataaatatgctattttaaaaaataagaatttcttcaagttgaaatcattatggttgattgcttgccctaaactctttgctatccaggaaagctaatgagcrtcttctatctgcagtgctactgaaaacatgtctttcctttcatagggaccctaactgagggtgggacacagaagacgtttgacaagcaaatcgtgctact

SEQ ID NO: 81658 - DNA, 201 bp, Homo sapiens
taaaactcagtttagaccttctgatctttctccaaacacatatcaccaaccatgtgattaggcattttgttaggccagagacaggacaataactgtactgygtatcaagctctacttatggttttatcaggtctctcaaatgttacatttatttgaaatattagaagaaattgaactatttctgctctttgacattaacag

SEQ ID NO: 81659 - DNA, 201 bp, Homo sapiens
caactatctgtgctgaaagaccttttttcccctctaatctccactaagcaacacttttgttttttattctgttaagcgagatgaacgcactggtcatgtgyttagagtcacagcaatgtcaaattgctttagaaaaacaaaagtttactaaatatttcattctcatttttctctccttgtgttattttgacccagtaatca

SEQ ID NO: 81660 - DNA, 201 bp, Homo sapiens
gactatcctcccatctcatgttaataggctaagtatgtcttattaaacaccacaaagaagatatcacccattcttatattctgagatggtttactaatcaraggcgattcaattctctgattatatttaaataataattgttcaggtaccctggaaaattaacttgctaaactttaatttacaaataacatttgttattct

SEQ ID NO: 81661 - DNA, 201 bp, Homo sapiens
ccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacct

SEQ ID NO: 81662 - DNA, 201 bp, Homo sapiens
aggtgggaaaataaatcaacccacgttatgtggtatcgtgtaaacaaaataactgattgttctactacacatttttgctttaaaactgttgagattagagytcatataaatggagactaaaatctaaggaaatgatatcacaataggaaatcattttgttaccaaaataatgtataagcaacacatataaggaagagatac

SEQ ID NO: 81663 - DNA, 201 bp, Homo sapiens
aacgcctggctaatttttgtatttttttgtagagatgaggtttcaccatgttgcccaggctggtcttgaactcctgagctcaagtgatccacctgcttcakcctcccaaagtgctggggttacaggtttgagccactgaacctagctgagaagatgacttcaaagacagtgtcctaaaaaatctaccgggcaggggaaggg

SEQ ID NO: 81664 - DNA, 201 bp, Homo sapiens
cacgccccaacgcctggctaatttttgtatttttttgtagagatgaggtttcaccatgttgcccaggctggtcttgaactcctgagctcaagtgatccacstgcttcagcctcccaaagtgctggggttacaggtttgagccactgaacctagctgagaagatgacttcaaagacagtgtcctaaaaaatctaccgggcag

SEQ ID NO: 81665 - DNA, 201 bp, Homo sapiens
cttgtgagttccttcagtacagggactgtatttgatccaggtagccagaaactttctaacacagtgcctggcatgtagaaagtaaaacctcattcttgatktctgcacccataacctcctgtctctgctgtgttctcccattgcagtaactaataacatcatttacccagttgttctgataaaacaccttgaggtcatcct

SEQ ID NO: 81666 - DNA, 201 bp, Homo sapiens; identical to SEQ ID NO: 59858

SEQ ID NO: 81667 - DNA, 201 bp, Homo sapiens
aaactaggaaaggaaaaagaaaagaaagggaagagaaaggaaggggagggaaaggattaatcatttcagttttcaaaaagtgtagttgcttcagtaagagkagttttattggccttttaccccatcatgtaaaacatttcaggcttttttccccagatccttgttgtctgcctacatccacactgatgttctcaccttctt

SEQ ID NO: 81668 - DNA, 201 bp, Homo sapiens
gtggtgtgatcatggctcactgcaacctccacttcctgggctcaggcgattctcgcacctcagcctctcaagtagctgggactacaggcacacgccccaaygcctggctaatttttgtatttttttgtagagatgaggtttcaccatgttgcccaggctggtcttgaactcctgagctcaagtgatccacctgcttcagcc

SEQ ID NO: 81669 - DNA, 201 bp, Homo sapiens; identical to SEQ ID NO: 59870

SEQ ID NO: 81670 - DNA, 201 bp, Homo sapiens
gagcatagaaatgggcatatgtgaatctttccaaataataaaagttcactattgaaggacatatgcatctccagagaactcatcttagctatccccagatktgagagtggtgaaaacgcaatcctcagaaactgcccacatgtcttgatggctgttactcctccaggtgcttcttaccttgaccacacattccctgcggag

SEQ ID NO: 81671 - DNA, 201 bp, Homo sapiens
agtacatgagcatagaaatgggcatatgtgaatctttccaaataataaaagttcactattgaaggacatatgcatctccagagaactcatcttagctatcmccagatttgagagtggtgaaaacgcaatcctcagaaactgcccacatgtcttgatggctgttactcctccaggtgcttcttaccttgaccacacattccc

SEQ ID NO: 81672 - DNA, 201 bp, Homo sapiens
tatcaaagcctttgtaagtacatgagcatagaaatgggcatatgtgaatctttccaaataataaaagttcactattgaaggacatatgcatctccagagarctcatcttagctatccccagatttgagagtggtgaaaacgcaatcctcagaaactgcccacatgtcttgatggctgttactcctccaggtgcttcttacc

SEQ ID NO: 81673 - DNA, 201 bp, Homo sapiens
acaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatt

SEQ ID NO: 81674 - DNA, 201 bp, Homo sapiens
ccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaa

SEQ ID NO: 81675 - DNA, 201 bp, Homo sapiens
ggagcatagaagtctaggctccccattcagcctttgctgttgtgggttggggaggggcctcaggtttttctgtggtgtttggctaaaggagagaagtcagygtccaccagttttctatcatatctcgctatgctgccctttactggtactttggttagagaaagcagattttatttgggctttttcagtctgtactcattg

SEQ ID NO: 81676 - DNA, 201 bp, Homo sapiens
ggtcctattatcagagcccaggtcagagacacactcaaagtaagtaacacaaatacagaatcatgggagaaattacatagtaaaatattatggagtacctrgttattttttaattttaaaagaaaaagatgctcatataattttaaattcaaatgcaacttttagtttttatttagtatttgtatttatttacagcttact

SEQ ID NO: 81677 - DNA, 201 bp, Homo sapiens
aaaggattaatcatttcagttttcaaaaagtgtagttgcttcagtaagaggagttttattggccttttaccccatcatgtaaaacatttcaggcttttttycccagatccttgttgtctgcctacatccacactgatgttctcaccttcttctcgtaaagaatttatcaagttattgtaccaaacaaaaataactgcatcc

SEQ ID NO: 81678 - DNA, 201 bp, Homo sapiens
ataatttctcaaaccaaattggaaaacattataagaaagttatgtacacacagtacgaagatgagtccttcaccaaacatacagtgaatcccaatatgaargaagatgggattttgggtcctattatcagagcccaggtcagagacacactcaaagtaagtaacacaaatacagaatcatgggagaaattacatagtaaaa

SEQ ID NO: 81679 - DNA, 201 bp, Homo sapiens
ttggataatttctcaaaccaaattggaaaacattataagaaagttatgtacacacagtacgaagatgagtccttcaccaaacatacagtgaatcccaataygaaagaagatgggattttgggtcctattatcagagcccaggtcagagacacactcaaagtaagtaacacaaatacagaatcatgggagaaattacatagt

SEQ ID NO: 81680 - DNA, 201 bp, Homo sapiens
cccatgagaatccagcccatctttcattaaaacaaacaaccacagtgagccacagcatgggaaataacgtgatggactcaccatctgcctatacatacacrctcaggccatacctacatacatgcccaatgtatttactcattatacaaagactttttttccatttcctggtatatataagatactgtgatggtactgaaa

SEQ ID NO: 81681 - DNA, 201 bp, Homo sapiens
acactaaactttatctttacagttttgtgttacatttttaaggtgatcaagtttctcaggaactttttaaaaaatccgcgtattttactgtggggagagtmgataaagcctgagaaccctagttatctaatctgagaagtgggcagaggagttgtcataccaataagagaataaacatgacttgctatggttgctggatac

SEQ ID NO: 81682 - DNA, 201 bp, Homo sapiens; identical to SEQ ID NO: 59928

SEQ ID NO: 81683 - DNA, 201 bp, Homo sapiens
aaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagtt

SEQ ID NO: 81684 - DNA, 201 bp, Homo sapiens
gacaaaacatataaaacagaagttttcagacatcgaatgacagacaactcaagacagtaaaagaagagtaacaaaccagatgtgccctatgagcacctaarcttactgcttgaagagtgtttccagggaacagcacaagcagggagaacccagacagagtctctatgggttgaggaaatagagtttggacttcggagaagc

SEQ ID NO: 81685 - DNA, 201 bp, Homo sapiens
agatttaccctttttctcaacaactagacaggcagacaaaacatataaaacagaagttttcagacatcgaatgacagacaactcaagacagtaaaagaagwgtaacaaaccagatgtgccctatgagcacctaagcttactgcttgaagagtgtttccagggaacagcacaagcagggagaacccagacagagtctctatg

SEQ ID NO: 81686 - DNA, 201 bp, Homo sapiens
tccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagg

SEQ ID NO: 81687 - DNA, 201 bp, Homo sapiens; identical to SEQ ID NO: 59952

SEQ ID NO: 81688 - DNA, 201 bp, Homo sapiens
atttctaattttggaatgtcctttccctttccttttatgcctggttaacttccacttggtgtaaacatttctccctttgggaaagctttccctgatccctrgaatagattgggtctctctctctcactctcccgctaagactgcctcctagaactgctcatgggaggtaataatgtgttcctttgtgtgattgtctgtttc

SEQ ID NO: 81689 - DNA, 201 bp, Homo sapiens
tcaatacgttgcacattgttacttctgcccaagttaccttcaatgaaaatggtttagtccattttcattcctaaccttatattataaggctgtattatgaktgtgccaagtacagttcctattgttttgatttgaatataactgcagctaccatagaggtctaagggaattttcattaccttccctttactccatgttgga

SEQ ID NO: 81690 - DNA, 201 bp, Homo sapiens
aattgtttgcctttcctgagtgctatttaataggattcacacttgcattctgttaccaaattaatggactttcttttaaagttaatacaaagcattaattrtagtctttttttttttttcagtgacttagtgggtttttcttaaccttacagtctagtgttggatagtaagataatcatccctatccagctgaggcagaag

SEQ ID NO: 81691 - DNA, 201 bp, Homo sapiens
gctatttaataggattcacacttgcattctgttaccaaattaatggactttcttttaaagttaatacaaagcattaattatagtctttttttttttttcartgacttagtgggtttttcttaaccttacagtctagtgttggatagtaagataatcatccctatccagctgaggcagaaggaagtcgatttgatttctcag

SEQ ID NO: 81692 - DNA, 201 bp, Homo sapiens
tctgttaccaaattaatggactttcttttaaagttaatacaaagcattaattatagtctttttttttttttcagtgacttagtgggtttttcttaaccttwcagtctagtgttggatagtaagataatcatccctatccagctgaggcagaaggaagtcgatttgatttctcagtactgttgagtgtggaaggctagagaa

SEQ ID NO: 81693 - DNA, 201 bp, Homo sapiens
ttaattaatattttaaaataatacaacttgcctagttttttgcttgggtgcctttgaataatgatcttcctcccctcctcacagccctttcccccactccmactatagccagaaagagaggtgaaagcagttgaacattagaaaagaagtcttttaatgtggtagttaactgtatttctgaaaactagatactgccctgct

SEQ ID NO: 81694 - DNA, 201 bp, Homo sapiens
aaggtgttaatggaatgcaggagagcaggctcctgaatggctgattaactaatatttttatatcctcaagtaatgttaaaaccatgcagtcttagtggaaraaaagagtgacttccagctgggcagaactctacttgatatgacccaaaaattaatatgtgtggttaggaagctgtatctcttatagaggcagttttactc

SEQ ID NO: 81695 - DNA, 201 bp, Homo sapiens
tactctccacttccatgagtttgacttttttttttttttttgtatttttagtagagatggagtttcactgtgttagccaggatggtcttgatctcacctcktgatctgcccacctcggcctcccaaagtactgggattacaggcgtgagccaccacacccagtctctttcatcttttgataatagttgttataacaggtgt

SEQ ID NO: 81696 - DNA, 201 bp, Homo sapiens
gctgggattacaggcgtgagccaccgcgcctggccaaaattgattgttaattgtgaaaaagcaagttgcaaagcaccatgccatttgtatgtgtgtctgckttggggaggagtcgatgggtataaaagatagaaggtttgcatatgcctaaaaaaatgagacctgcgagtctctattaacactaattcttgggataagccg

SEQ ID NO: 81697 - DNA, 201 bp, Homo sapiens
agattattaaaataatttcaatttaaaaatgaaatccggggtgttttgcagattaccatgtgtcctacttcatagctggtgtatcttcatgaaagtttatraaatgctgactgcttagcattgcaaagagaccttgataccattttttccaaacttccccctaacattagatttcctttaaaaaatatttctgataataat

SEQ ID NO: 81698 - DNA, 201 bp, Homo sapiens
tctatttgattatttttattatcgagttgtaggagttccttacatattctggatacaagtcctctgtcagatttgtgtgttatgatcattttctctcagtyggtggtttgttcattttcacagtggtggttttgattaagcaacatttaaaaatgttgttaagtgcaacttataatttttttctttctgtgccttctcttt

SEQ ID NO: 81699 - DNA, 201 bp, Homo sapiens
ccaacagaaagccttatcatttagagatgatgtcagtatgaacctgaatggaagcactgaagttgtgacgaatgtttggattctgaatatattttgaatgytgagctgataggacaaatagattgtagagtgagagaggaagaagaattgaggatgactccaaggtttttggtctaggcatggcaggctgaaattaccatt

SEQ ID NO: 81700 - DNA, 201 bp, Homo sapiens
gcaagtctttatagaatttgattgtcatttgattaattattattgtctatttgattatttttattatcgagttgtaggagttccttacatattctggatamaagtcctctgtcagatttgtgtgttatgatcattttctctcagttggtggtttgttcattttcacagtggtggttttgattaagcaacatttaaaaatgt

SEQ ID NO: 81701 - DNA, 201 bp, Homo sapiens
tttagagatgatgtcagtatgaacctgaatggaagcactgaagttgtgacgaatgtttggattctgaatatattttgaatgttgagctgataggacaaatwgattgtagagtgagagaggaagaagaattgaggatgactccaaggtttttggtctaggcatggcaggctgaaattaccatttgctgagatggatagaaag

SEQ ID NO: 81702 - DNA, 201 bp, Homo sapiens
acaaggtcaagagattgagaccatcctggccaacatggtgaaaccccgtctctactaaaaatacaaaaattagccaggcatggtggtgcatgcctgtaatytcagctactcaggaggctgaggcaggagaatcgcttgaacccgggaggcagaggttgccgggagccaggattgcgccactgcactccagcctggcaacag

SEQ ID NO: 81703 - DNA, 201 bp, Homo sapiens
aactaattgaagcaattttttcttaagatctgtggtttaactgtgcatacttttctttatccatctcctaaccctcaacaaatcagttcgttctttccacrtattgtaaatcccaccataaaactgagtgatgttctataatttagttaccatacttcttattcgtagaagtatcagattccagttctctccagaaatatc

SEQ ID NO: 81704 - DNA, 201 bp, Homo sapiens
aatgaaacaagaaccaccaccagatgggcactgatcagatgaaaagtacggaaagtgtatgctgcgggagcacagagaaaggaaaggttatttgatgaagrcatgatattttaaaaattcctttgaagatttatctttgttggtcaagaaaacagttttctgaacaagttgaaacatagactttctgacttatctctgtat

SEQ ID NO: 81705 - DNA, 201 bp, Homo sapiens
ggggtgggtgttacagaaagaagacactttgtggaaaagggccagcttttggaaagcttgggccattacagggaacagaattgatcagtaacatttatgarttaatcatagaaagttctgactttttgccaatgccataaagatatatgacattttagaaacttgaattttgctgaaccaagaacttgaatcaggctttct

SEQ ID NO: 81706 - DNA, 201 bp, Homo sapiens
tctttctatggggcacagattctccggtttgctgcagtatccaccactctatattgtatggcaggccctaaggcccacttcatgcatttatgttacttgtycagcctttgcagagatcgtcaatacatttttgaatgcctgcttatttcataggagacactgtagtggttgatgtagtgtccagactagtatgaagcttga

SEQ ID NO: 81707 - DNA, 201 bp, Homo sapiens
gagagaaatagaaataaagtgctgtatttgatcaaaatagagaacagttatagcagagcgatttggaaaggctttgtggaaaatgtgaaatcagaattgarccttgaggaatgagtagggtttcatttggtatagatgggggtgggtgttacagaaagaagacactttgtggaaaagggccagcttttggaaagcttgggc

SEQ ID NO: 81708 - DNA, 201 bp, Homo sapiens
ggtgccatagaaagcttttttttttttcttcaagagacaaggtctcgcttgtcacccaggctggaagtacagtggtgcaatcatggcttgctgcagccttyacctcctgggcccaagtgatcctccaacctcaccgtccccagaagctgggactacaggtgcatgccatcacaccagctaattttttaattttttttagag

SEQ ID NO: 81709 - DNA, 201 bp, Homo sapiens
ttttgatattatttataggtactaacattttaaaaaatgcagtttttttgagatcaaattttcacttttcctatttgggtggctatttaaagatgcatccrggcacaattcagacatacaagatacttcagttcagtggtttcttgaattacacctaaaatccaaaggaacgtgtttctgaaagtggctgccaattttttt

SEQ ID NO: 81710 - DNA, 201 bp, Homo sapiens
aaatttctgtttttgaacaattgattcaacacatattgagtgctcctggatgtaaggaattttacagaacttaaagatgaatcaggcaaataaaatacttyggaataaaaaagtctcacttcaggctgggcatggtggctcacgcctgtaatcccagcactttgggaggccaaggcagacagatcacaaggtcaggagatc

SEQ ID NO: 81711 - DNA, 201 bp, Homo sapiens
gagcatctgtattctgatcattgtcatctccctgaagttgtggtttcttttaggtgtgtattttgtgaatgcatacgattgcatcgactggtctgattttrtcagcagtgactagtctgtctacttctactttgtattcagagacattacctataagcagagttggtagcttcctaccaatatagttccatggatgcttgg

SEQ ID NO: 81712 - DNA, 201 bp, Homo sapiens
ctctctggagtgaaaagagtgtcttgtttgctaatgagatgactggtgactggaggctcctagataatttcaggatgaaggctggtcactggaaagaccaragcatgattagaaggttggaactttcagtccaccctagatgtccagggaggggagagggtctggagattaagctcatcaccaatgaccaaagaattaatc

SEQ ID NO: 81713 - DNA, 201 bp, Homo sapiens
ctttaagaaattagaacaaaggaagcagcatagaaaaaagatacaagctacatagagtacttgttttgagtttttttctttctatatgttgcaaccacttygtgtcactgaagacttacggctttctactgtagccatttgtgtacacgccttctctttcagttagtctgaagcagctttaggacaggattcttgtcttat

SEQ ID NO: 81714 - DNA, 201 bp, Homo sapiens
aagatggactttggctaaagcaacagaaaatgaatttattgggagtcttgagtagtccatagactcagtgggaagtttggggaaccaggtttgtacaccgrgcagatgtccaggcagccataaacatggctttaggaacagcctggttaggggctggctgctgtggctccgcagccaccagacgtttgctttccacgagat

SEQ ID NO: 81715 - DNA, 201 bp, Homo sapiens
tttgcacatgttattcttccctgtttttcactttctcattcttaaaggcttattcaaatatcttcccctttatggtagaaaaactccactccatatcatckgaatcccaacattaaagcctaatacatgggtactgaccttctacctaaaaggctggttttgaatgagtgattttcagtatgagaaatgaatgactcaaga

SEQ ID NO: 81716 - DNA, 201 bp, Homo sapiens
gttattattatcgttaatcataagttaatgacagaagttctaaagagtccttaatttcaaataagtgactatcaattgtactttaagaaattagaacaaargaagcagcatagaaaaaagatacaagctacatagagtacttgttttgagtttttttctttctatatgttgcaaccacttcgtgtcactgaagacttacgg

SEQ ID NO: 81717 - DNA, 201 bp, Homo sapiens
atcataatccttatattgatatactacaatctacccactttccccctatttttagacgttttattataaatagtgtgacaataaattttttatcagtcacygttctgggttgcaagtaacaaagatggactttggctaaagcaacagaaaatgaatttattgggagtcttgagtagtccatagactcagtgggaagtttgg

SEQ ID NO: 81718 - DNA, 201 bp, Homo sapiens
tcttttctgagctaggaaggagtcacattagttgagagactttatcactttcagtccagtacttccccagccccatgaaaaaaagtgtacccatcaaacartccccttctgccatctttatcttatcaggatctctcttctttaatagatgagactctttggaaaggactttaattggctgatgccacagactcatcccgg

SEQ ID NO: 81719 - DNA, 201 bp, Homo sapiens
ctttcaaacaaccaaatttcatgagaacactgtcagaagaacagcaatgattcagtcacctaccaccaggcccctcctccgacactgggaattacaattcracatgagatttgggtggggacacagagtcaaaacatatcagatattatctggctgtgaccttattttttttttcttcagcagtcccttttttttccttaa

SEQ ID NO: 81720 - DNA, 201 bp, Homo sapiens
tctcttgcttcagagggcagaaatagaattatgggttttagaaggggagggttgataaaatgagagcagtgcctggagataggtactccatgaaaatgcarccccacgggggagaggagaaatcagagctgagagggaagaaggctgaactagagtggacaaggctagaaaaaagaaggcaaaaccgaaagaaagtagcag

SEQ ID NO: 81721 - DNA, 201 bp, Homo sapiens
ggtgatccatcatcccacaataataatgtcagtgctttcctgagtgagcccaaactcttttgcagagtttgaataatgttgagatcaatgcttttttcatytgctgagatgggaagagctgacctcctgatctcttaaacataagctttggcaccttgaatggttggaagccaagccgtaacatcgctctgtgtacctagg

SEQ ID NO: 81722 - DNA, 201 bp, Homo sapiens
cttcctctcttgctactttcctttgtggtttgataattttctgtgatggtatgctttgaatcttttccttttatattttgtgcaactattacaggtttttrtttgtgtttaccatcaggtttatataaaacatcttgtacaggctgggcatggttgtgcatacctgtagtcccatctacttggaaggatgaagtgggaaga

SEQ ID NO: 81723 - DNA, 201 bp, Homo sapiens
ctatttctagagcaaaatgaaagatttgtggagctctttagctgatccaggtcattgttggttgcctgtgcctgtgcctttattgacatgtattatgcggytctgcgcatgcttccatctcattgctccctctgcaagctgtaataagtctcccttgacaggctgcttagggcgtttacaagacatttggccttttggtga

SEQ ID NO: 81724 - DNA, 201 bp, Homo sapiens
tttaatagtttgattatgatttgtcttggtgcactcatctttggcttgaatttaattggagatctctgagctttctatacctggatgttgtcatatttccrcaaattttggaaactttcagccatattttcttaaatatattttctgggcctttttctttatcatatctttcttagaattttattataagaaagttagttt

SEQ ID NO: 81725 - DNA, 201 bp, Homo sapiens
ttcaggagtattaatgaagatattcttgtctgtaaatagttggttggatttttgttgggggtatgggagctgagcaacacccattctgccatcttcctgastagaacttccagctgtaatgtttttatttagcagcagagttcacttacaaatgcaattcagttagatgggtgtggtttgctttcttcacaccaaagatct

SEQ ID NO: 81726 - DNA, 201 bp, Homo sapiens
aacttccagctgtaatgtttttatttagcagcagagttcacttacaaatgcaattcagttagatgggtgtggtttgctttcttcacaccaaagatcttcakttaataaatgaactgtgaaaactttgttctactctgaaattgaagtatattgtccttctttttggataaagtgtttttattagaaagtatctgaatctcc

SEQ ID NO: 81727 - DNA, 201 bp, Homo sapiens
atggtggcaggcacctgtaatcccagctactcaggaggctgaggcagaagaattacttgaacccaggaagcggttgcagtgagctgagatcgcgccactayactccagcctgggtgacagcgagactccatctcaaaaaaaaaaaaaaaaaaaaatcatgtctgcttaggttgaaagataagtcaaatttccttatataat

SEQ ID NO: 81728 - DNA, 201 bp, Homo sapiens
acaaatgcaattcagttagatgggtgtggtttgctttcttcacaccaaagatcttcagttaataaatgaactgtgaaaactttgttctactctgaaattgmagtatattgtccttctttttggataaagtgtttttattagaaagtatctgaatctcctctgacttctgaaatcaaacttacaaaattggatgcaatcatt

SEQ ID NO: 81729 - DNA, 201 bp, Homo sapiens
tagaatatctgaagttggagttttactaacctcattatttataattattaaaatagcttgctgatcaattttattctaaaatactaaattgtccattatgygctttctacaaaagtgtgcatcaaaactgaatgctgtgtcagttttcttgacaaaaagccctttgaagacataactaatgaggagttgctgcgtgtttgg

SEQ ID NO: 81730 - DNA, 201 bp, Homo sapiens
tgaacccaggaagcggttgcagtgagctgagatcgcgccactatactccagcctgggtgacagcgagactccatctcaaaaaaaaaaaaaaaaaaaaatcrtgtctgcttaggttgaaagataagtcaaatttccttatataatattggttaatttgcattgattattcatatttagttgcctaagatggtaacctgaaaa

SEQ ID NO: 81731 - DNA, 201 bp, Homo sapiens
agaatatctgaagttggagttttactaacctcattatttataattattaaaatagcttgctgatcaattttattctaaaatactaaattgtccattatgtrctttctacaaaagtgtgcatcaaaactgaatgctgtgtcagttttcttgacaaaaagccctttgaagacataactaatgaggagttgctgcgtgtttggc

SEQ ID NO: 81732 - DNA, 201 bp, Homo sapiens
attcatatttagttgcctaagatggtaacctgaaaactaatgttaatggattcttcattttttaaaggacaagctaaaaaacacagaataaatattaaaarttgtggaaagatagtcacccattttattttatgttaaaagtacacagttaatactcttgttaagttgcaaattaagttagtgtcagagcgtttttgtatt

SEQ ID NO: 81733 - DNA, 201 bp, Homo sapiens
acaacaacaaaaagaaatgtagagtgccaggcccactgcagacctactgaatcagagcctgaattttaagataccccgcaggtgatttgtgtgcatgttamagagtgagaagctccggactaaatggtttactacttacttctactttaggattatcaaaaataaatggtggtagtgaaaataatgtacagaaagtacctt

SEQ ID NO: 81734 - DNA, 201 bp, Homo sapiens
ctctgacatgcctgaaaatgcttttgagtccactgctcagagatggcctcacaatagcaccctgctctgtgacaaaggcagagtggaatgggcaccttccyaactgaagcaagtagatgctttttcaaaaggaaaccaaagcaattgtttatatgcttggaagatgtcttattcattggaggctgaatgctgagtctgttt

SEQ ID NO: 81735 - DNA, 201 bp, Homo sapiens
cgggccctcaacctgtctacttttcctcctctgcaaatgatggcatgaaatggaggcacacatgatcctctgagtttgagtagttaagaataaatgattgycttgttcttataaacattttttgatttttttctcttttaaaatattaatagttcagaacccttccaaaaaatgtcacttactttagtaaacttctgttgt

SEQ ID NO: 81736 - DNA, 201 bp, Homo sapiens
tttttctctaagttttatcaacttccataccctaataaactttggttgatgaaagtgatgagaaatagagaatgccagctcaagcaatagcacataattayaaatattttgatgtttttaactgattattggagaaaccatgtttttatcagctggtgtgtctttttccagaagacacgtgatttcatgatttgcctttaa

SEQ ID NO: 81737 - DNA, 201 bp, Homo sapiens
aattgcattaagctttctttgatgatgtgaattgggggagatagatacgtagtggttgaaaggaggaatctattaaaggcaaaagagaccacacgattttmtgggcttttccaacttgtatctaacaatttgtataggttgacttagaacagtgcagaaagaattggctttcaaatcgaagtgaggtaatctccagaggtt

SEQ ID NO: 81738 - DNA, 201 bp, Homo sapiens
ttttttgaacacccaggacaactctatgaaataagccccattttacagatgagaaaactgaggcttagagaagtaacttgcccaaagtcacacacctgctstgaggaggaaataatgcacttttcattcattagcgctttcaccagatgtcatatttatctattttttacagatggttaaaagaataatatggaaatttga

SEQ ID NO: 81739 - DNA, 201 bp, Homo sapiens
aattgctagtctagcttttaaaattctctatctatcactcgctctctatctatctatctatctaccccctcacagggctttaagcctcttgaaagaagtayaaagaagatagactgatgactgtccccctggtaactggcacttcagagagggtgagagaattcacagataattctcttttctgagctaggaaggagtcac

SEQ ID NO: 81740 - DNA, 201 bp, Homo sapiens
ccagagactaagaaccaggcctttactctgatgtctacacttaaattctttttttaagctttgtactcttcatgatattatagtgtatgctgttgtgtcaygttaaaaaaaactcatggtacttttgatttattaaaaaaattattttctttaatcaagtcattgagttatgagaagtgataacctttaaatgtaatatca

SEQ ID NO: 81741 - DNA, 201 bp, Homo sapiens
cttattgactggagttccccctacattacaaagcacctaataagatgatcttttcctatcagcattaaaaatttttttttcgactttgtagaaaataatcsttttgcagcacttaaagagaatcacttgcgggcattctgtaaaattttacattttactgacagcacaaaacaggaaattgttttttctttttggtgagta

SEQ ID NO: 81742 - DNA, 201 bp, Homo sapiens
atgatattttgcaaatagatacagacaagtaggcagaactgtctgccccattctcctgccaacaacaaacaaaacataaaacataattccaaataagggamatgcccattactcagactttccctttgaatctaataatgtcacccaagtcttgaggaatttgctaattgtttgtagatcctacaaggtcataatctagac

SEQ ID NO: 81743 - DNA, 201 bp, Homo sapiens
tgctccttgtgaaaatctaatgcctgatgacctaaggtgggacagtttcatccaaaaaccatacccctcccccacccctccccctattgcctaaagggttrgggaccactgtctgagagacttcatttcattgctttaaaatcaagagagtagtgcaagatgacctctgttcttttgccagcgattcttggcacacttatt

SEQ ID NO: 81744 - DNA, 201 bp, Homo sapiens
cataatttgtgaccagactttaaaaaaacattgtggtcaatgatgttgcacaattactttttgtctgtcacatagacaaaacaaatccagatttaattcartgcaaacaaataaataaaatgctctgctaagagtatagagtcaagcttttgatctagtgggagaggctgagactgatcgaaaatataaggcagaaataaa

SEQ ID NO: 81745 - DNA, 201 bp, Homo sapiens
agtggaatataaatttctgtttttgaacaattgattcaacacatattgagtgctcctggatgtaaggaattttacagaacttaaagatgaatcaggcaaayaaaatactttggaataaaaaagtctcacttcaggctgggcatggtggctcacgcctgtaatcccagcactttgggaggccaaggcagacagatcacaagg

SEQ ID NO: 81746 - DNA, 201 bp, Homo sapiens
ggtagaaggaaagggaaatctctctggaagaacacaataatttaaacgtagaccttaataaattcccacaaataaaactgaagggccttgaatccacggtrgaggactcctcccatccccaacacataaagaaataaactatcatgagcaatcattaattgaaaaaacacactatagagtcagttccacgtagactgcaga

SEQ ID NO: 81747 - DNA, 201 bp, Homo sapiens
ttgaagaagggtaggaagggactggaatagagctagtgaagatgagaaaaaagcaatggtaaacaatcaggtagcccaggggaggttggaaaccctgctgygaaatggagccagtcaggaaggctgaaaggtttctctgacagccctcagcagtccaccaaagctggagatgagggttgatgagttgaggcaagggtgagg

SEQ ID NO: 81748 - DNA, 201 bp, Homo sapiens
tttgagacggaatctcgctctgtcaccaggctggagttcagtggcgcgatctcggctcactgcaagctccgcctcctgggttcaagtgattctcctgcctyagcctcctgagtagctgggactataggcatgtgccaccatgcccagctaatttttgtatttttagtagagatggggtttcaccatgttggtcaggatggg

SEQ ID NO: 81749 - DNA, 201 bp, Homo sapiens
aaccctgtagcagctttgtaaaacttttcaccaaatcattttctctacaattgtagatgaccatgatctttgtggaccatccaaagatttaaatatcagtwgcctataggtaatccttctgattcatagtaagcactttctctaagctgtcacttgaaggctggggatctagcttcatgccagttgaagcaacctcagggg

SEQ ID NO: 81750 - DNA, 201 bp, Homo sapiens
ataaccctgtagcagctttgtaaaacttttcaccaaatcattttctctacaattgtagatgaccatgatctttgtggaccatccaaagatttaaatatcastagcctataggtaatccttctgattcatagtaagcactttctctaagctgtcacttgaaggctggggatctagcttcatgccagttgaagcaacctcagg

SEQ ID NO: 81751 - DNA, 201 bp, Homo sapiens
ggctggcagataacaaaaccagaaactatttcatattattcttttactaacccaatgttaattctgtttgtgtgtgttgtgtgtgtgtgtgtgtgtgtttktgtgtgtatgtgaagacctgggcactgttatagccacttgaaaggtatattttggcaaaaatatagcctgagaatgacctggtgacccttgtttcctctt

SEQ ID NO: 81752 - DNA, 201 bp, Homo sapiens
caggctggcagataacaaaaccagaaactatttcatattattcttttactaacccaatgttaattctgtttgtgtgtgttgtgtgtgtgtgtgtgtgtgtktgtgtgtgtatgtgaagacctgggcactgttatagccacttgaaaggtatattttggcaaaaatatagcctgagaatgacctggtgacccttgtttcctc

SEQ ID NO: 81753 - DNA, 201 bp, Homo sapiens
gagggcagaaccttgtgatattcatattgaatcaccagtgcctagcataatacatatgttcagtaggcattatttttgaatgaatgtaatgaatgggtttkatgagataatatggaacaaacattagttgaatgaaagatgatcaattaagtttgtgaaacccaagcaactgattttatagatgctatgttacttttaagg

SEQ ID NO: 81754 - DNA, 201 bp, Homo sapiens
cgcaggtatttatagggcccgggaaggtcacctaaagagtgctgtggcccaatgtttgcacttgtttacatactaaacttgagaaatatcctttgcttctrtgaagaaatacactgtcctatgttccttgaagcacttagctctattgtatatcttttattcccctgcatttaataaggacatgatggagtgaatgctgct

SEQ ID NO: 81755 - DNA, 201 bp, Homo sapiens
gccccattttacagatgagaaaactgaggcttagagaagtaacttgcccaaagtcacacacctgctctgaggaggaaataatgcacttttcattcattagmgctttcaccagatgtcatatttatctattttttacagatggttaaaagaataatatggaaatttgagttgcttgtcattttgcattaaacattgtgtgaa

SEQ ID NO: 81756 - DNA, 201 bp, Homo sapiens
agtggaataaaccccagatgatgcatccacagggcttttgtttttgtatctcttttttttgaccaccaaaaaaaccacttttttaaaattatatatatttraagtatacaacatgatgttttgatatacattgtgaaatggttattatagtcaagcaaattaacacattcatttcacatagttaccctctttgcgtatgtg

SEQ ID NO: 81757 - DNA, 201 bp, Homo sapiens
tggtttatttcacttagcataatgtcatccatgttcattcgtgtggcaaatggcaggatctccttttttaaggctaaataatatttctctgtatgtgtgtrtatcacagtttctgtatccattcatccatcaacagacatttcagttgtttcagtatcttgactattgtgaataatgctgcaatgaacaaggaaatgtgga

SEQ ID NO: 81758 - DNA, 201 bp, Homo sapiens
gagtctcctctcccgtccacaggactggcagcccggcccccagtgttcaggccagggacggcctgaaagtggggccttactggggaccctgcccccttccrccccggactctgtctgcctcctgctgccgttcatggccctggggctcggccccaaccccgctccgagattggagctggggactgggagcggagagaggcc

SEQ ID NO: 81759 - DNA, 201 bp, Homo sapiens
tacacaatttcacaatgtcctggaagtttgtggccccctaggttgacattcggatcgctcgagccagttgaatagttatatgacaatacatgatctaactyctttaactgaaaacaaacctaaagtcatcactgtttttggaccaataggcattgagaagttgtaagcttgatcttttaaaaaatggagacatccactgac

SEQ ID NO: 81760 - DNA, 201 bp, Homo sapiens
agtttttttttttcagtacttgcctgtaaatcatagtgctgaaaagtgcttttgaacattgtgtatctagatactgctcctcatccatggtggagatgctyatttgtcccagcttctgaatttgaaactactttggcagaagttctcatgagttcttggagaccataaagcaaatcatgggcaattaaaacaaaggtctct

SEQ ID NO: 81761 - DNA, 201 bp, Homo sapiens
ctgttttagcgatgggagaagaaagagtgagctaaggggcagtataggaaccctgggggttactggaaacgcctgcatctaggattgatttgtcagtaaakgctggaaaagtagcttaattctgtgtttcagggttaggctgaggctgctgatacacatttgtcttggtcaagactggttgaggaagtgggatttgattta

SEQ ID NO: 81762 - DNA, 201 bp, Homo sapiens
ctcaggaacagccgttttaaatgctcaagcctaattgatacggacatggcacactcggccgggcagctggaagttaatgcattttcctgtagcgaggggargtgttcgggacagtcgcaggcattcagctgtgatgagcatgaaatttcaggagggaggtgtgtttggaaggatcgagcctataggcgaaatttcagaaat

SEQ ID NO: 81763 - DNA, 201 bp, Homo sapiens
gggcttggcagtgtgcgcccgtagtcccagctacttgggaggctgaggcaggagaactgcttgaacccaggaggcagagattgcagtgagccgagattgcrccactgcacactccagcctgggtgacagaatgagactccgtctcaaaaaaaaaaaaaaaaaaaaaaaaagaagtaggaatggtagggaagtgtaaggagg

SEQ ID NO: 81764 - DNA, 201 bp, Homo sapiens
tcagaaataaagaccagacttgatgttcccacttatttgggtaacacctactgtttttttacaaaaagaaagaagtacattgtctcaatttccccagatayatctagaagctccagaataaattcaggcaatttgagactcacaagtattaaccagtctctaatgggtagttggcaggcttatttctgatcagaaaacact

SEQ ID NO: 81765 - DNA, 201 bp, Homo sapiens
caaacaagagagtagttttctgttggttggggcgctctacaggcttctctgcccatccagtcttctaactccactctgctctaaatcatttccctggtccyattatataagctttatatagggggcttggtggttaagggccagactgcttggggtttgaatctcacttagtagctgtgtgaccttggcaggtcccctgag

SEQ ID NO: 81766 - DNA, 201 bp, Homo sapiens
gtctcaggcataagcaggcagcctgtagatggtgagtaggtggaggagctgtgctttgagctcttttcacatgtcagggagtttgtgctgaggcacctgcwgcttgcctagttggttcccatggtattaggtgtagtggctttagccatggataagagtttttccaccaggttaactacttgtatggagacaatctgagat

SEQ ID NO: 81767 - DNA, 201 bp, Homo sapiens
aggtgagtgtctcaggcataagcaggcagcctgtagatggtgagtaggtggaggagctgtgctttgagctcttttcacatgtcagggagtttgtgctgagscacctgctgcttgcctagttggttcccatggtattaggtgtagtggctttagccatggataagagtttttccaccaggttaactacttgtatggagacaa

SEQ ID NO: 81768 - DNA, 201 bp, Homo sapiens
cgtggtggctcacacctgtaatcccagcactttggaggccaaggtgggtggatcacaaggtcaagagattgagaccatcctggccaacatggtgaaacccygtctctactaaaaatacaaaaattagccaggcatggtggtgcatgcctgtaatctcagctactcaggaggctgaggcaggagaatcgcttgaacccggga

SEQ ID NO: 81769 - DNA, 201 bp, Homo sapiens
tccgatatcatagactacatttcaaatctaaatgtatacctttatatttttcttaatataaagcactgggtcttaaataagtattagcttttatacttagmaataagaaaaaaaggaattttgaagtttaaagtttctattgaaatggagcaaatttgctaggcaaaaccaccccccaccacacacacacatgcacacaca

SEQ ID NO: 81770 - DNA, 201 bp, Homo sapiens
tcttaaataagtattagcttttatacttagcaataagaaaaaaaggaattttgaagtttaaagtttctattgaaatggagcaaatttgctaggcaaaaccrccccccaccacacacacacatgcacacacacacgcgcacacacacatgcacccacacacgcacccacatgtgcatgaaataggaaaatagtatagtctct

SEQ ID NO: 81771 - DNA, 201 bp, Homo sapiens
tggaaggagcagccttaaattctgtggcatgattttggttgtgattgggtagcctactgttgttcctgattgttttccagtaccttccatagccttctcartgattatgtgggaatatccaccatcgtttcaattaattcagtttctgcttaaagcagccagtcttagttttgttatttctgttatttgcaagtaagaacc

SEQ ID NO: 81772 - DNA, 201 bp, Homo sapiens
tgattgggtagcctactgttgttcctgattgttttccagtaccttccatagccttctcaatgattatgtgggaatatccaccatcgtttcaattaattcartttctgcttaaagcagccagtcttagttttgttatttctgttatttgcaagtaagaacctagattgatagggagtttgaaaccaggaatggttccgggaa

SEQ ID NO: 81773 - DNA, 201 bp, Homo sapiens
acagtgacacaaatatttgtttttcgtggaaaaatttggtagttctccctaaaatcttccctatgttttgaacttatagcttaaattctctttttgtttgyaattactaatatattattagtaactagttaattttaatgcattccaaatctttcttggcctacttcatgtttttcttgctcaacataaagacatgtcatt

SEQ ID NO: 81774 - DNA, 201 bp, Homo sapiens
gctaaccctcaaggctcagttgctttgaggtggtatgtgacagcacatttccagcctgtgaatgatgttttttttttttctttaaattagaaacctgaccrtgatggtgaaagaaatatggaagtaactccaggagaaaagatacttaggaacaccaaagagcaacgcgatctgcataatcggctgagagagattgatgaa

SEQ ID NO: 81775 - DNA, 201 bp, Homo sapiens
ctccttctgcttcccaaatgattacagaagttgggttcctttcctacttgttatatgtacagttggacatttacctcctaaaatgggaagactttaaagcrttatacatattgttttgaagggaagaaataattgtttgagaagcaaagctaaccctcaaggctcagttgctttgaggtggtatgtgacagcacatttcca

SEQ ID NO: 81776 - DNA, 201 bp, Homo sapiens
ttgtatacagggaaaagttgggaatgctaactcgtgctgtgatggcatgcataaaacaataagcagtaagatatataaatatataattgtaaagaacagtrttattaatgaagtccaaattatataggagcttttctgcagcttacctttgcactgtgtatgaggagcacagagattgctaagcaaactaatattatagct

SEQ ID NO: 81777 - DNA, 201 bp, Homo sapiens
ccacagcttctctggaccctgcctctgctgttcaaaaaagcaaaagaaagatgagtcattttgtagggtaagaaaaggacattgttgggtagaggcaattkcctttttcattctgttatggttgaatgtataattgataggaatttaggaaaggatttgttggaagacacccattcacatgtaaatccgagtatgagaggg

SEQ ID NO: 81778 - DNA, 201 bp, Homo sapiens
gttaatcagctaacgccagtcagcatcatgaaatccagcaatagtctttcaatcccctgaaaatgacttagtaccgaacatgtaacagttcctccatattwtcttcatacaatcgtctcgggtatgcgccctccccttagtgctttggcctctgctccccgtgttcctgaaggaggatgtcagggtggttttgtttgctaa

SEQ ID NO: 81779 - DNA, 201 bp, Homo sapiens
atagttaacaatagtttcttattttctttcagagtttgggccttttagattgcatcaaataaagatgagctactttaaaagacagtctgcggtactatttkaagagagatggtttagttacaagtcagtaacttagattcatgagaaaattttgtgttgacattccataagatgagttggcattagaattggaagtccagt

SEQ ID NO: 81780 - DNA, 201 bp, Homo sapiens
gagatttaaaacagattagcagcttggttccatcccagatgaattaagtcaatttctaggggtgggttctggcagcagtcatttaagtcagtttctgagawcagggtctgggtgattctgctgtgcagccatgctttaaaaccccaaggctccatgctattcattcatcatccatctgccatccattcattcatcgattta

SEQ ID NO: 81781 - DNA, 201 bp, Homo sapiens
atccaatagatttactcttttactatgaaatgtgtgtgtattggctgaaacgagaaagaagattcataaaagagctactaaaatgaaggtgggaagagagrggctttcatatacagagtgaaaagagattgggttctggcctggaaaaatgaggactgagatgcactatgttgagttttatgaaggataggaatagtatga

SEQ ID NO: 81782 - DNA, 201 bp, Homo sapiens
tgtggcaccaatgagctgctagaaattctgtcacgtactactataagagcaagaagtccaagcacttagggagataatattgttggaggggatatatcatrggtatggagagctgtattccaattgttttccttgagagggtcctgatgagatgctcttcaacaagagcctaagagatacagtgaggagggaccaactggc

SEQ ID NO: 81783 - DNA, 201 bp, Homo sapiens
gagcctaagagatacagtgaggagggaccaactggcttcattggaaaaaaaaaatttggctgttctctgtagacctctgatgcttgtgaagtatggtaccrttgaaatgggactccctaatcttactagggatattaggatcctggggtaatagagcttaagcagcagcaccttaccatcagaaagcaaggtgggtaggca

SEQ ID NO: 81784 - DNA, 201 bp, Homo sapiens
cctggggtaatagagcttaagcagcagcaccttaccatcagaaagcaaggtgggtaggcagcatggcttccataataggcagcaggatgggtatttaatcrggatgaccaggaatctttgggaatggctactgataatgggattcctgtgactgaaatgcataggtgcttagctatgccacctgatttttacaaccaaaaa

SEQ ID NO: 81785 - DNA, 201 bp, Homo sapiens
ttagctatgccacctgatttttacaaccaaaaaactctgggtcttctggcaaatggaggcttgatttaagctattacaataggaaatcatagcccccatcygattgttcccagacaggtcagttcataagcccaacatcccttacatggaactaaggtcaagaacttgctagatccggccctttgaaagagtgtacttact

SEQ ID NO: 81786 - DNA, 201 bp, Homo sapiens
gacaggtcagttcataagcccaacatcccttacatggaactaaggtcaagaacttgctagatccggccctttgaaagagtgtacttactagagtaattggrgaaatggaaatatggagagattactggaacatgtgtcctcttcaggataaagtttctagtaactcaatacatgccttgatctttggtatgcatgtatcta

SEQ ID NO: 81787 - DNA, 201 bp, Homo sapiens
aatgctttttttactaaaggcacataagcagagaataaacagtttgcttgtacctcataggggcagcagaataacttcattgccttgcttttaggcctctrtcttctttttggctctgtgttaccattttgtctgcaaggtttcacacagggcaccatgttagtccaatatattgtgacattgtgctcataggatcctggg

SEQ ID NO: 81788 - DNA, 201 bp, Homo sapiens
gaatcaatacatgtattatgcctagagcagagtctagtctgcttagtgaatgctacctatttattattattctgtaagacataacctagtgtgccaaccasatgcaagatgcagcagaactaaaactgcatgtgtattctattcttttcctgatgaaaaatccaatagatttactcttttactatgaaatgtgtgtgtatt

SEQ ID NO: 81789 - DNA, 201 bp, Homo sapiens
atgacagtgaagcttcattctctatgcctcaccattttcacagtaatgatcactgtgttttagatactttattttgttctgagaagtagctctaaacaggycacatgctagtgtggtgaagacaatgaagaaaggggaaaatggtttgagaaagttgcagttcttggccaaaaaatgaaattgctggataaatcaaagtag

SEQ ID NO: 81790 - DNA, 201 bp, Homo sapiens
aggtaggtattttctgacaactagttctacatttatatctcaaataactcttcagtgagtacccagatttaatgagatcagtgaagtttggaaacacttcsatcattaatcttgtagttgactatagaactaaattaagtggcaggttccttctgatggttacgtacttcatagtaattatagttcaaaaatatgatattt

SEQ ID NO: 81791 - DNA, 201 bp, Homo sapiens
aatgtcatctctcttcttcataaaaaaataaagcagggttgaggggacagagggtagggagtgtggagatggggataattattttatacagggtggttggraaaggccctcctgaggaagcggacgcctgaggaaagagaggagcaaaccaggtggatagctgggaaactgtatttcaggctggtgtgtgtgtgtgtgtat

SEQ ID NO: 81792 - DNA, 201 bp, Homo sapiens
ttggatccttgaagccatggagccagcccgggcacctgggccacgggagacgagccatcacagaatgcccagggccacagcagcctctcaccaggcaaacscataaggcaagccctgcctcacccggctgtttggggaagatgggtagcctaggcatgggtggggtctgattctgcacggtgactttgccatgccaggccc

SEQ ID NO: 81793 - DNA, 201 bp, Homo sapiens
agttccgaatggctggggaggccttaggaaacttaggatcatggcggaaggcagaggcacatcttacatggcagcaggcaagagagagagcacacgggggraactgtcacttttaaaaccatcagatcttgtgagaactttctcactatcacaagaacagcatgggggaaaccacccctgtgttccaatcacctcccacta

SEQ ID NO: 81794 - DNA, 201 bp, Homo sapiens
gaagcaaagaaagagagtaaatataagagctgtatcattgacctgactactgcttgctagcaagtacagctgattgatcttgtgggacatatgcagagagrtgccatgtgggtgacttgtgggacacatgcagagagatgccatgtgggtgacttgtgggacatatgcagagagataccatgtgggtgacttgtgggacat

SEQ ID NO: 81795 - DNA, 201 bp, Homo sapiens
gctcaaagtgatatctttcaaatatctttctatcatccagctatggggcttggattctattcttagaatcacctcttcaggttaagtcattctgattcaaygaggctcctataaaatgtgagtttgttccttgagagagttgtacattgacctagattgcttagactcagggacagtagtgaggaagcacacctcaggatt

SEQ ID NO: 81796 - DNA, 201 bp, Homo sapiens
cccagtgtggcctgatttgagggtgctcaaagtgatatctttcaaatatctttctatcatccagctatggggcttggattctattcttagaatcacctctkcaggttaagtcattctgattcaacgaggctcctataaaatgtgagtttgttccttgagagagttgtacattgacctagattgcttagactcagggacagt

SEQ ID NO: 81797 - DNA, 201 bp, Homo sapiens
tgtgattaacaagttaaatgtggagttaactgtatggcactagatttatacccaagaggaaaatcagatctgatgaaatttgtcaggactgaccatttgtmgaaccagactaggcctaactttgcccagtgtggcctgatttgagggtgctcaaagtgatatctttcaaatatctttctatcatccagctatggggcttgg

SEQ ID NO: 81798 - DNA, 201 bp, Homo sapiens
aagtaaataaggagagctttccctgtaaatacttatgaacagaaatggttttctgccatgtttgtgaggctttctattaatatatatgtacttgaataggyttctataattaaacctaaccacaatcaaagactgtgattattattcagttctattttcacagcagaccaaattaaacctctatgtcagacttgtagtgaa

SEQ ID NO: 81799 - DNA, 201 bp, Homo sapiens
tgctgcaaagctctaggatatgggtagtgaggcttacgttatagtcttgcgcggttttgttatgacataggaaggagagcagattttggccttaaatcatrtaaatggtaaagtggcaaccagagacttgaagctatgactcatagttcatgcaatgaacctctgaaacatttcatcaggtaaaccaggaaaacgactttc

SEQ ID NO: 81800 - DNA, 201 bp, Homo sapiens
tgagtggtccagtggaaggagcagccttaaattctgtggcatgattttggttgtgattgggtagcctactgttgttcctgattgttttccagtaccttccrtagccttctcaatgattatgtgggaatatccaccatcgtttcaattaattcagtttctgcttaaagcagccagtcttagttttgttatttctgttatttg

SEQ ID NO: 81801 - DNA, 201 bp, Homo sapiens
ggcaacatggcaaaacctcatctctacaaaaaaattaaaaaattagccgggcatggtggtgcgtatctgtagtcccagctacttgggaggctaggtgggaraataacttgagcccagcaggtggagattgtagtgagccaagattgagccactgcactccagcctgggtgacagagtcggaccctgtctcaacaacaacaa

SEQ ID NO: 81802 - DNA, 201 bp, Homo sapiens
aaataagtgactcagcaccaccatctagtgcagaggccagagcttgtgctagctcattggaaatcaaaggagaaaatattaacatgacatgattagaaaaygttcacatgaaagatgggggctcttttttggtttgctgatttgaaatatttatttaaataaagtaaataaggagagctttccctgtaaatacttatgaac

SEQ ID NO: 81803 - DNA, 201 bp, Homo sapiens
atcacattttcagatgccggatagagtgtggagggggcatgttatggtaccatgctgctgccaggtgctccccctcgaaaaaggagtttaactaactcttstaagcatgtgtctgaagacaattagtgtgaaaaggccctaactttatagtctggcttcattttttttattagttctgggccctggaccattcaatttctc

SEQ ID NO: 81804 - DNA, 201 bp, Homo sapiens
ttcagatgccggatagagtgtggagggggcatgttatggtaccatgctgctgccaggtgctccccctcgaaaaaggagtttaactaactcttctaagcatstgtctgaagacaattagtgtgaaaaggccctaactttatagtctggcttcattttttttattagttctgggccctggaccattcaatttctctgaggctt

SEQ ID NO: 81805 - DNA, 201 bp, Homo sapiens
atgattttccaattttccccactaggtagttggaagaggtaaatggaataaatactgtatgtggtgcatagtagatggtccagggctatcagccctgttcmctccatgccccacccccagtgcaactgactaatgacctgggctggtctggatacccacctaataagggacccgctgacagggagggaggtggacggattc

SEQ ID NO: 81806 - DNA, 201 bp, Homo sapiens
gcatagtagatggtccagggctatcagccctgttccctccatgccccacccccagtgcaactgactaatgacctgggctggtctggatacccacctaatawgggacccgctgacagggagggaggtggacggattcatctctttcttaaagtttcttgctctgtgtgaaagggaaactatttaaatgtgtcatttaagaga

SEQ ID NO: 81807 - DNA, 201 bp, Homo sapiens
ccagttgaacttggaaagtacaggcttcagtgtacagcttccaagagaggccatctggctgctgctgctgctgccagcttccagacggaagctgagatttrctattgatgttccagcattgattgagctcctgcctcgtctgcatcaggcatggtcctcgcagcttcacgcaggtatttcatgctattgcaaattgttgct

SEQ ID NO: 81808 - DNA, 201 bp, Homo sapiens
gcttcagtgtacagcttccaagagaggccatctggctgctgctgctgctgccagcttccagacggaagctgagatttgctattgatgttccagcattgatygagctcctgcctcgtctgcatcaggcatggtcctcgcagcttcacgcaggtatttcatgctattgcaaattgttgcttgttagtattcctcccaactagt

SEQ ID NO: 81809 - DNA, 201 bp, Homo sapiens
ctgctgctgctgctgccagcttccagacggaagctgagatttgctattgatgttccagcattgattgagctcctgcctcgtctgcatcaggcatggtcctygcagcttcacgcaggtatttcatgctattgcaaattgttgcttgttagtattcctcccaactagttgtttggagtcagctagttgttagtatttttactc

SEQ ID NO: 81810 - DNA, 201 bp, Homo sapiens
tctgagactttgaaaggttaagtgatttgcccaataccaaacagctggggaatgagagagccggaatctaaagttagaaatgtcagcctccccctgctaasttctgctgttggtaagggtatttcctctccctctggggctttctattgctttcagagagagagtttgcaagctgaaggaacacttaacttgagaggcttt

SEQ ID NO: 81811 - DNA, 201 bp, Homo sapiens
tctaaaatcactgagtactcactaattcctctgaccactcacatatctcctgtcattctcctagaattgaatttctggttctccagtgttgctccattggytctcctcttagttgcactttttggagggcagattgctttaacatgctttgctataatgtactctaaacatgcttaacgggaagtgtgaaatcaggttatt

SEQ ID NO: 81812 - DNA, 201 bp, Homo sapiens
cattttcctgtagcgaggggaagtgttcgggacagtcgcaggcattcagctgtgatgagcatgaaatttcaggagggaggtgtgtttggaaggatcgagcstataggcgaaatttcagaaattgagtttttaaaatactaaaagcctgatgagaaatctcaaagtgtaactgggtgtctgacagaatattttaagtgatag

SEQ ID NO: 81813 - DNA, 201 bp, Homo sapiens
taatttggggagaatttctaactttgtgatattaaatcttgtcatgtattaatattgtatctcagttgatctattaacttttaatttttagttaaaaaaaktcacatacaataaaattcacttttttggtgtatagttctatgagttttggaagatagattgagtgatataactaccattacaatcaagatatggagcagt

SEQ ID NO: 81814 - DNA, 201 bp, Homo sapiens
tctcgtcccagatatgccagtagaaaccacctattaatccatgagccccaaggatcctgaagcatcactttgcctcctatctcctatggcgttgacagtgytggccataaccctgcagtacctgcacccagccagtgccagcatgtgagccttgttgacagtctgcagaggctggttggagctgctaaccctgtgcttcca

SEQ ID NO: 81815 - DNA, 201 bp, Homo sapiens
acctgcacccagccagtgccagcatgtgagccttgttgacagtctgcagaggctggttggagctgctaaccctgtgcttccaggcccacgctgtttggttyggttcgagttgcccttcagagccctgcccagccctgacttggaagctgttgcttattgtgtcttagtgtggagcagtggggcctgaggcaaaagtatatt

SEQ ID NO: 81816 - DNA, 201 bp, Homo sapiens
ccatgtgggtgacttgtgggacacatgcagagagatgccatgtgggtgacttgtgggacatatgcagagagataccatgtgggtgacttgtgggacatatkcagagagctgccatgtgggtgactgcacttcagggagtctttctgggggaaagtaactccttcactgccttccctctccccttggtcaaagtctgcccca

SEQ ID NO: 81817 - DNA, 201 bp, Homo sapiens
cttgtgagaactttctcactatcacaagaacagcatgggggaaaccacccctgtgttccaatcacctcccactagatccctccctcagcacatgaggattrcaatttgagataagatttgggtggggacacagagccaaaccatatcgctgacctacgggcagactgtgcaaggccaggtactaccttccaggccatgcca

SEQ ID NO: 81818 - DNA, 201 bp, Homo sapiens
gtactaccttccaggccatgccacatctccaccttctttcagcaccagtacaaggtggagggttttggatacactcccctgacctggccttaaatgaaccsctgtttgggaagatcctttacagacacagcacctccatcttcaggccagctcaacacagaagacacatgttgaagatcccagagacagagttctgaggat

SEQ ID NO: 81819 - DNA, 201 bp, Homo sapiens
agctcaacacagaagacacatgttgaagatcccagagacagagttctgaggataccttctcttcaattgtgaagtttagatgatatcaagcaaagtatttraagttctagagactcctgtgggcatacataagttctttaggtttcatttataccagatttctccaatgtgactcatctatcagctgatttcctgcaagag

SEQ ID NO: 81820 - DNA, 201 bp, Homo sapiens
gacacatgttgaagatcccagagacagagttctgaggataccttctcttcaattgtgaagtttagatgatatcaagcaaagtatttaaagttctagagacycctgtgggcatacataagttctttaggtttcatttataccagatttctccaatgtgactcatctatcagctgatttcctgcaagagggtgaggtttaatc

SEQ ID NO: 81821 - DNA, 201 bp, Homo sapiens
ggagaatggaaaagggagggaaggagctaggagaggaaggaagaacaagcccttttctcctatgaatccttagcgccattgatacagacattaaaatgaayaccaattatttttcccccttgatttttagatgtgtttaatccaaaagagctatagcaagtgatgtgagcctattgtgagcattcagactcgatagtgctg

SEQ ID NO: 81822 - DNA, 201 bp, Homo sapiens
taaaatgaacaccaattatttttcccccttgatttttagatgtgtttaatccaaaagagctatagcaagtgatgtgagcctattgtgagcattcagactcratagtgctgttctgtagcctaactggagtgcctttatttttctatgcacaggtaggtattttctgacaactagttctacatttatatctcaaataactct

SEQ ID NO: 81823 - DNA, 201 bp, Homo sapiens
gagcaagtctcatcttacgtggatggcagcaagcaaagagaaagggcttgtgcaaggaaattcccccttttaaagctatcagatctcttgagactcattcrctgttatgagaacatcatgggaaagacctgaccccatgattcaattatctcccacccggtccctcccacaacaggtgggagttaggggagctacaagatg

SEQ ID NO: 81824 - DNA, 201 bp, Homo sapiens
ggacgtatttattatttttaaatgggtggccagtcaatatatgtgaagaaaaagcgaggcgaaggaattgtagctacttgagaactagtgtggtaagcaarcaaggaaaggctgggtttagattccaactgacctgatctcccagttcatgttctctctggctctgtgaccagacaagtgacacggtcactctgacctcta

SEQ ID NO: 81825 - DNA, 201 bp, Homo sapiens
tcagtggcggcctgtgtaggctgaagtggacagcccttctgtcacccttgttcagggactgaatatgggccaccttggaaagtgggagagctcaggcaagyagcactctgcagctgaggctggccctaaggttgctgcctcctgaaggctgtctgctgaccacccactccacagctgggcacaaaggcctttcttgaaggg

SEQ ID NO: 81826 - DNA, 201 bp, Homo sapiens
aaggaagggggaggaagcagttttgggtagagagaggagctgaactgccatgcaggcctggcaagccttgtgaatgcagcaagggtttctagtcagtggcrgcctgtgtaggctgaagtggacagcccttctgtcacccttgttcagggactgaatatgggccaccttggaaagtgggagagctcaggcaagtagcactct

SEQ ID NO: 81827 - DNA, 201 bp, Homo sapiens
aacttgatgaacaagtattttctttgcaaatgaagtatgtcctgtaaatgattacacattaataaaaacaagaatcaacctgatttgttttaacacctctrtttctctgcaggaggtagcatttttctgtcagtttgtcaagtgttattttttcagcctccctctggcctgagtggtatatatgtggtttggttttgaatt

SEQ ID NO: 81828 - DNA, 201 bp, Homo sapiens
aattcctggagggtgttgtatgttttgttttctcagtgcaagacatctttgaggtttcctttgccatcaaaggctttctatgtgtgtttgttggggatggyggggggatttataggaaaggactttcactgagatataaaataattttccccaggaggatttttactttgctagtcttgttttggtatctattttgggcaa

SEQ ID NO: 81829 - DNA, 201 bp, Homo sapiens
gcagtgtgaaggtgccacctagtggtcacataatcacgtctgtgttctctttcttgccagtggaaattgggtacccgtggtgggtttcctagagaatcccyttataggtggtgaattcggttagcctattgctgtccttgataggataaagtttttacttttactttgtggtcactgaaattatcatcctccaaatttgtt

SEQ ID NO: 81830 - DNA, 201 bp, Homo sapiens
ttaaaatctattcttctgtgttccttcagtttttgtttcatcttcatgaaaaccttagaggcaggtggcatagctatcactacctctattgttacagatarggacaccagacatagggctttggtgacttgtccataacccacatctgacttccaggagagttctttaaacacacacagcctctatcactattatttgatt

SEQ ID NO: 81831 - DNA, 201 bp, Homo sapiens
ttagatgattccttaactattgagggcagttagggatgtttgtgatggagccctagtttagttcagttcagtatttgtaaataaattatatcaatatagtrccttaaaaaatggtttaagcactctaatcattcaattctcatgatagtcattgactgagctttgactgtgggcaagactctgctgggaatcaaaagatga

SEQ ID NO: 81832 - DNA, 201 bp, Homo sapiens
tttaatgtagagattatcttctaaagttcctcattttacagataaaggagatgagcccctgagaactcaggtgacatgctcaaggcagcaaagcttggatrgaagcccaggttctagtcttctgtgttttctttcctatccagctgcttcccccaggaggatcagggtaattgtagtccagcttatttctgtgtacacaca

SEQ ID NO: 81833 - DNA, 201 bp, Homo sapiens
agaagctttacctaatagtggagaattaactatactagtatcagtaatagctttttatttcagtactttacatatgcagaatatttagttattttttactrtgtaccttcagagtaggccaataacattattttactttgctgaagtagaaattaaagtcattgaaattcatgattaagttttcttatggggacttcttgt

SEQ ID NO: 81834 - DNA, 201 bp, Homo sapiens
aaatgtttttaaatatttaaggtcttggttgaaacacttagccctggtaacctttacaagcagagattaagtatgcatgatcaaatcattctccccaaatrcaccgcctctggaatgcccctggcctctgcctagacctgtagctttgcagcaacgacacattgcaggatgcaccacccttcacccttccttttctgtctt

SEQ ID NO: 81835 - DNA, 201 bp, Homo sapiens
gagattaagtatgcatgatcaaatcattctccccaaatacaccgcctctggaatgcccctggcctctgcctagacctgtagctttgcagcaacgacacatygcaggatgcaccacccttcacccttccttttctgtcttcagcagtattgtccactgatagttgtggacagacatgggagtgctgaatccccagaggtagg

SEQ ID NO: 81836 - DNA, 201 bp, Homo sapiens
tatatttgtattactggatgcctaccaaaaataaatgtgtttactcagtcaactgactatgtaatcttttggtttgtttcatcagttagagtccacatcaygtctctctgaagaacagttaaagtgtcttctggatgaatgcatacttaaacaaaaatccatcattaaactttcttcagaaagaaaaaaggaagacattga

SEQ ID NO: 81837 - DNA, 201 bp, Homo sapiens
aaaataaatgtgtttactcagtcaactgactatgtaatcttttggtttgtttcatcagttagagtccacatcatgtctctctgaagaacagttaaagtgtyttctggatgaatgcatacttaaacaaaaatccatcattaaactttcttcagaaagaaaaaaggaagacattgaggacgtaacacctgtgttcccccagct

SEQ ID NO: 81838 - DNA, 201 bp, Homo sapiens
gaagctcttgtcactgaagcagagaatatgaaatgccttcaattttccaaggacgttattattagtgacacaaaagactattttatgtcgaagactcttgscattgggagactgaaaaggccctccttcttagatgatccactgtatggtatcagtgtgagcctttcatcagaagaccaacatctgaaactcagttctcca

SEQ ID NO: 81839 - DNA, 201 bp, Homo sapiens
tctaaagtgctgccttaagccaagtgcctgtttaataaataaaagaatttaaatgtataaccagttttagaataaaacactgaaaatatggttcacatttmttctttacattaccaatgaaagtaggtaatgttgcttaagaattatgtaagtcacacattctatataaatatttggattttttgtttcttacatgaaatt

SEQ ID NO: 81840 - DNA, 201 bp, Homo sapiens
caaaagcatttatatactttcatgtataagccctgcatcatctctagagtgtgttttgagtaagtaatgtcaatgaaatcaccatctaattatgttcttgygaaagcgcctgctactacctttgaagtttgctgctaatctcttcttaccttcatttcttagtatctaaggtttagataagcagtgacaattaaaaacata

SEQ ID NO: 81841 - DNA, 201 bp, Homo sapiens
agctagtgaagatgagaaaaaagcaatggtaaacaatcaggtagcccaggggaggttggaaaccctgctgtgaaatggagccagtcaggaaggctgaaagrtttctctgacagccctcagcagtccaccaaagctggagatgagggttgatgagttgaggcaagggtgaggagaggttgggtgattgcagtgaaagatcaa

SEQ ID NO: 81842 - DNA, 201 bp, Homo sapiens
actctgtaaattagcgacctctccgtatggtcagagtgggagggtagagtggggattgaagaagggtaggaagggactggaatagagctagtgaagatgaraaaaaagcaatggtaaacaatcaggtagcccaggggaggttggaaaccctgctgtgaaatggagccagtcaggaaggctgaaaggtttctctgacagccc

SEQ ID NO: 81843 - DNA, 201 bp, Homo sapiens
aatatggcatttacataagcttgtttccaggataaggggggaaggacatcgtatggagggcaacattgaagatggaggggtaagccttggagaagaaccarggtacccttttcctgacttggggtgaaagaaaggaagggtgggccaagaaaggcaggatgagagatgaagagaaggtgggtgaggccatgtttgaatgtt

SEQ ID NO: 81844 - DNA, 201 bp, Homo sapiens
acttgtatggagacaatctgagatgttagaatgaagagataatgggagtatccgctttcatagaataggcaccataagacagcccccacagacagtctctycatcatttcccataccagtgatgtttgtctctggtacttcaaaccagacaaacaagagagtagttttctgttggttggggcgctctacaggcttctctgc

SEQ ID NO: 81845 - DNA, 201 bp, Homo sapiens
cctcctgcaatggaacatcctttcaggattactggtggaagaggtaatctgtggccactgaattggtgatctagggatcaaacccatatcctgttttagcsatgggagaagaaagagtgagctaaggggcagtataggaaccctgggggttactggaaacgcctgcatctaggattgatttgtcagtaaaggctggaaaag

SEQ ID NO: 81846 - DNA, 201 bp, Homo sapiens
caatgcttttttcatctgctgagatgggaagagctgacctcctgatctcttaaacataagctttggcaccttgaatggttggaagccaagccgtaacatcrctctgtgtacctaggtgaagcctcaggttgtttatatttgtgctttctcctgtgtccacagcttctctggaccctgcctctgctgttcaaaaaagcaaaa

SEQ ID NO: 81847 - DNA, 201 bp, Homo sapiens
ccccctaatgagagttaggcagcagatctaaagggaatgaatacatcgtgctttttttatagctcatttttatttgctttgcatgagaaatctcatgggcrttatatttcagggagacctctatttccattttcagagagatttctctgattctgttgatgggatgaagtagaagaagtaggaatgggctgggtgcggtgg

SEQ ID NO: 81848 - DNA, 201 bp, Homo sapiens
taattaattttttttaagaaaaaaatagaggcaggttctcactatgttgcccaggctggtctcgaacttctgggctcaagtgacctgcccacctcagcctrccaaagtgctaggattacaggtgtgggccaccgcacccgtccatctctcttatttaaagtttaattgtaaccaacacttgtaccaaaaaaggtttcagtc

SEQ ID NO: 81849 - DNA, 201 bp, Homo sapiens
cataggacaagctgtctttatttaggcaggtttgtattttcccaatcctaacgcatgccttatttgcatatcagataacttacgaagctgcgggtaatttsctgtttttgatttttgaaaatgagtttattttgcttcaaagatcccttttggcctagtcaacaccacagataatttttctaaggataaactcagaatctc

SEQ ID NO: 81850 - DNA, 201 bp, Homo sapiens
tttctttatccatctcctaaccctcaacaaatcagttcgttctttccacgtattgtaaatcccaccataaaactgagtgatgttctataatttagttaccrtacttcttattcgtagaagtatcagattccagttctctccagaaatatctaagatataggagttatgtaagcattcagtttcttaaatccttagcaaccg

SEQ ID NO: 81851 - DNA, 201 bp, Homo sapiens
taattatatacatttgtggggtaaagtatgatgatttgatgtatgtatacaatgtgagatgagtaaattaagctaatttacattatctatcacctcacttaccatttttttgtggtaagacacttgaaatttactcttagttattttgaaacatacaatatgtgattaatgactgtagttaccctgctgtgcaattcatct

SEQ ID NO: 81852 - DNA, 201 bp, Homo sapiens
tcatgggttttggagagcttttgggttggtatacatgtagaggtgctgggagggtggggtgcacagagaggacaatgacattctgtgctccttccacgtayatctccctatgcatctgttccgtttggctgttcctcagtagtatcctttatagtaaagcagtaatagtaagttaactattttcctgagttctgggagtca

SEQ ID NO: 81853 - DNA, 201 bp, Homo sapiens
aatttgcctagttctccagcttcacctttgtacctcattaccttctgctctttctgagttaggatcatatgagatgatggatgtgaaaggtcttggggtaygctgaagtgtgctatccatctagttatgttttgtatattctttattcccccatgtgaaacccagccgcagaggaaggtctgctaagttgctttataccaa

SEQ ID NO: 81854 - DNA, 201 bp, Homo sapiens
gataggaatagtatgaataataacttgtttatggaatactgggaaattagagctggcacgaaagatgaatactttgaggtgaatacttgaacagatggttdcttgacagtgcctgcacagtgagtggttcagttatggtgcttattagctcagaatttttgagagcaatctggaaaaaggctgtgggttagatgattcctt

SEQ ID NO: 81855 - DNA, 201 bp, Homo sapiens
ttttttttgtatttttagtagagacagggtttcaccgtgtagcccaggctggtctcgaactcctgagctcaggcaatccacctgcctcagccttccaaagygctaggatattcattcttaagtgagcaggcaaactattcctaataaataatgagagagggtgtaatatctactgctgtacagttgtggttttatctattt

SEQ ID NO: 81856 - DNA, 201 bp, Homo sapiens
atgaaaagtacggaaagtgtatgctgcgggagcacagagaaaggaaaggttatttgatgaaggcatgatattttaaaaattcctttgaagatttatctttrttggtcaagaaaacagttttctgaacaagttgaaacatagactttctgacttatctctgtatggtaactataaggtagtaagttggtatgcatatagatt

SEQ ID NO: 81857 - DNA, 201 bp, Homo sapiens
gatgaaaagtacggaaagtgtatgctgcgggagcacagagaaaggaaaggttatttgatgaaggcatgatattttaaaaattcctttgaagatttatcttygttggtcaagaaaacagttttctgaacaagttgaaacatagactttctgacttatctctgtatggtaactataaggtagtaagttggtatgcatatagat

SEQ ID NO: 81858 - DNA, 201 bp, Homo sapiens
ggtagcttgtaggataccagaggatatgatgtaaacaatagaacaagttgtggagtaactgtgcaatgaaacaagaaccaccaccagatgggcactgatcrgatgaaaagtacggaaagtgtatgctgcgggagcacagagaaaggaaaggttatttgatgaaggcatgatattttaaaaattcctttgaagatttatctt

SEQ ID NO: 81859 - DNA, 201 bp, Homo sapiens
gatgtagtgtccagactagtatgaagcttgatctctgacctcaaggtagcttgtaggataccagaggatatgatgtaaacaatagaacaagttgtggagtractgtgcaatgaaacaagaaccaccaccagatgggcactgatcagatgaaaagtacggaaagtgtatgctgcgggagcacagagaaaggaaaggttattt

SEQ ID NO: 81860 - DNA, 201 bp, Homo sapiens
tgttacttgttcagcctttgcagagatcgtcaatacatttttgaatgcctgcttatttcataggagacactgtagtggttgatgtagtgtccagactagtrtgaagcttgatctctgacctcaaggtagcttgtaggataccagaggatatgatgtaaacaatagaacaagttgtggagtaactgtgcaatgaaacaagaa

SEQ ID NO: 81861 - DNA, 201 bp, Homo sapiens
ttctgcaaaccattaactcaccagtaatttttctccatactccttaagaaagaatttcttttgagtggaatataaatttctgtttttgaacaattgattcracacatattgagtgctcctggatgtaaggaattttacagaacttaaagatgaatcaggcaaataaaatactttggaataaaaaagtctcacttcaggctg

SEQ ID NO: 81862 - DNA, 201 bp, Homo sapiens
gcctaacataatctgtggatatcctagggggatgtctgccagtttcaaaaggtcccaaacaattcattatctttctctccaaacctacttcatctatagamtccctagtttagataatgtgaccaccataacctacttcacaaaatcaggaacttgttcttttttttttttctggtaaggccacaacaaagtttattattt

SEQ ID NO: 81863 - DNA, 201 bp, Homo sapiens
aaggcaattgtttttaggcccagcgtggtggctcacgcatgtaatctctgcactttgggaggccaaggcgggaggatcacttggggctaggagtttgagayaaccctggccaatatggcgaaaccccatctctactaaaaatacaacaattagccaggtttggtggtgcatgcctgtaatcccagctacttggcaggctga

SEQ ID NO: 81864 - DNA, 201 bp, Homo sapiens
ttctcataatgttaatcgtttttgtcattttgtacatacgagctccttctacagttttctaagttgggtttcaaccatgttgttctgctgcttagccatgyagctctcttttgagatttttaaaggcaattgtttttaggcccagcgtggtggctcacgcatgtaatctctgcactttgggaggccaaggcgggaggatca

SEQ ID NO: 81865 - DNA, 201 bp, Homo sapiens
tgccacaggtggctataggacctcttggatttctcttccaggtcttataacatctttctcataatgttaatcgtttttgtcattttgtacatacgagctcmttctacagttttctaagttgggtttcaaccatgttgttctgctgcttagccatgtagctctcttttgagatttttaaaggcaattgtttttaggcccagc

SEQ ID NO: 81866 - DNA, 201 bp, Homo sapiens
gatggtttcaatcttctgaccttgtgatccgcccgcctcggcttcccaaagtgctgggattacaggcgtgagctaccgcacccagcccaaatgctttttttactaaaggcacataagcagagaataaacagtttgcttgtacctcataggggcagcagaataacttcattgccttgcttttaggcctctatcttctttttg

SEQ ID NO: 81867 - DNA, 201 bp, Homo sapiens
tacatggaatgaggtttcaggccctgcctccactgaggcgcttcccactgggaagtactagagaatatttttaaagagtctctgtggacacagagcaagtwttaggtttttttgtttttgtttttgtttggtatatctagaaacacactttgtgaatgtgaaaggttctcttgtacccaactagaaataatcactgactgc

SEQ ID NO: 81868 - DNA, 201 bp, Homo sapiens
ttctctgttcatttctagtaatgtccaatattgttattataaaccatgacagagtgagcatttgtttaattattgtcttaggatatattcttaagtggaaktgctgagagtgtatgtgtagagtttggctgtgtgttgccaaattgtcctccagagaggttgtgtaatttattcttgcactaagaatattctagagtgcta

SEQ ID NO: 81869 - DNA, 201 bp, Homo sapiens
acatgttttcagttgtttattggcagtttgtgtttcttcttcagtgcattgcccatttgtatcttttttcatttatttattttattaaggtattcttttcrttttgtattggaaagctgtctttatatatttaaaacatatactctttgtcacatatgttacagattttactacctctaaagtgttaattttatttactgt

SEQ ID NO: 81870 - DNA, 201 bp, Homo sapiens
taaagaccagacttgatgttcccacttatttgggtaacacctactgtttttttacaaaaagaaagaagtacattgtctcaatttccccagatatatctagragctccagaataaattcaggcaatttgagactcacaagtattaaccagtctctaatgggtagttggcaggcttatttctgatcagaaaacactctatatt

SEQ ID NO: 81871 - DNA, 201 bp, Homo sapiens
gatctcttgagactcattcactgttatgagaacatcatgggaaagacctgaccccatgattcaattatctcccacccggtccctcccacaacaggtgggarttaggggagctacaagatgaaatttgggcaggaacatagagccaaactgtatcaaatggaaaaaagtttattgaattaggatataaagaaagaaagtttt

SEQ ID NO: 81872 - DNA, 201 bp, Homo sapiens
tccaatcacctcccactagatccctccctcagcacatgaggattacaatttgagataagatttgggtggggacacagagccaaaccatatcgctgacctaygggcagactgtgcaaggccaggtactaccttccaggccatgccacatctccaccttctttcagcaccagtacaaggtggagggttttggatacactcccc

SEQ ID NO: 81873 - DNA, 201 bp, Homo sapiens
gggcaaaattgctggtgctttatcatgaatcaggacaatggcaccaaaatgtactagtagtcattgtattctttgcaaccaggcactggcaggaaaaagamatagccagtgtcactggctatgaatcagtaaaaactatcaattttatgaaattttgacccttaaatatgcatcttcttaacatcctgtggggaaaaatgg

SEQ ID NO: 81874 - DNA, 201 bp, Homo sapiens
atttgaagtctccaccttggggacctaaaataaaaagagaaaaccataattatagttactcagtatgcatattctctgtattatgaacatcaagatttggrtgcattatctctggagagttaatgtgttattttagcacactcttacacatcctttttgtgcttaagttctagggaaatgctgtttaactatcttagcttc

SEQ ID NO: 81875 - DNA, 201 bp, Homo sapiens
aaaaagaaatagccagtgtcactggctatgaatcagtaaaaactatcaattttatgaaattttgacccttaaatatgcatcttcttaacatcctgtggggmaaaatgggaagtatacataaagcaattatgctgtgtaccgaagtttgaggttgtgttgaagaaaagtacttttgtgatggttggagttgagagctgaact

SEQ ID NO: 81876 - DNA, 201 bp, Homo sapiens
gctcagttctgcaatcctagagaagagcctgagtgatccagctgggtcaggggcctacccctggctcaaccaacttgtccaacccagcaaggtttggggtsactgtaggaacatggcagctatgtcaataccagactggagaggagaagaggacatttccagtgaagacagttctggccagataacccaatgtgttttccc

SEQ ID NO: 81877 - DNA, 201 bp, Homo sapiens
tcaggtatatgacttactctttttttgtagtagaggtagaaatggggatcatgtcagtcagtagacagtgtctgccacaggtggctataggacctcttggrtttctcttccaggtcttataacatctttctcataatgttaatcgtttttgtcattttgtacatacgagctccttctacagttttctaagttgggtttcaa

SEQ ID NO: 81878 - DNA, 201 bp, Homo sapiens
tcctgtctcaaagatattataattgaaattagctgctgacacagtttacattggatttgtttatattgttttagtactgcatgagttacttcaaaatgccygctatatagactacctatgttcacggagcctgagaatgctaggattggcagttgggaatgagaactagaaggtgttgcttttgaagtacataagcaataa

SEQ ID NO: 81879 - DNA, 201 bp, Homo sapiens
acattcctatgcggattttgtctttaggtttgcaagattgctgctacatctgtaggcagtgtgtccattttccaagcagacagaaagagggaagggtaaaragcaaagagactgtcctctgaggctttgctttttcactggggatggaatggtgtccccaggacttctacctgcatctcagcggccaagctgtatcgcgta

SEQ ID NO: 81880 - DNA, 201 bp, Homo sapiens
aaggacccagttatctcaactgtaaaatagagataaatgtctgtttcatagggttgttagataattatatagacaaacacatgtgaaagcaccttgtaaaytgagatacatggtaccaatgtagtagttattactatcagctataaatatttgttgaatgaaagaacaaattgtaagaacaaaacaaaactttatagtttt

SEQ ID NO: 81881 - DNA, 201 bp, Homo sapiens
tgtataaatcattccttgaattatttttctggaacttttttgaaaaattttgccccaagaaatggtgaagtgtggataatttttgagtgtttgtgtattcraatatttattttttcctcatttgaatgttagcttagcagatgactaaattctacttgcaaaatcctttttttcttgaagcatgtaggattttctccttat

SEQ ID NO: 81882 - DNA, 201 bp, Homo sapiens
tacctttaaaaacagtatgcttcttgtatgttaggaatctctctaaacaaaatttagccaaaatttttagccacatcattaactgtgtatttggactcaaygaattatttatttgtataaatcattccttgaattatttttctggaacttttttgaaaaattttgccccaagaaatggtgaagtgtggataatttttgagt

SEQ ID NO: 81883 - DNA, 201 bp, Homo sapiens
tgtgtccctcaaattcctggcccacagaagcatgagcataataaagtgttcactgttttatgccattaacttaaaaatttttattgtaaattgacaatttrtatttatggggtacaaaatgatattatgatttatgaatacaatatagaataattaaatcaagctaattcgcctatccatcacctcaaatacttaacatct

SEQ ID NO: 81884 - DNA, 201 bp, Homo sapiens
aaaaataatctgtacaacaaagccccatgacacaaatttacctgtataacaaacctgcacatgtacctctgaacttaaaatacaagttaaaattttttttwaaaaatcctgttttatacaattatttttattgaggttttcaaatttattcttggtcaattcattattgactttcaaaggattatttaatgtcattctaag

SEQ ID NO: 81885 - DNA, 201 bp, Homo sapiens
agtgttcactgttttatgccattaacttaaaaatttttattgtaaattgacaatttatatttatggggtacaaaatgatattatgatttatgaatacaatrtagaataattaaatcaagctaattcgcctatccatcacctcaaatacttaacatcttttatggtgagaccatttgaaatttagcctcttagcaattttga

SEQ ID NO: 81886 - DNA, 201 bp, Homo sapiens
aaatgcctaatcttgcaacttttctttgtgtatctgtagtgtagaagtctcagattccattttttttttcctgaactgtgaatttctttgagtatatgatrttttccattaataaattctgtagttggccaaggaatcaagaaacccagtggttatggttgacagagagaagaaaaggctggttgagcttttgaaggactt

SEQ ID NO: 81887 - DNA, 201 bp, Homo sapiens
tttttaaagctcctggcccgtatatttgacttaaatctatgctcacattgtatttctggagttatgtgactgctgtaggccctgtagacacttcccataaygttagattagtcctgatgttctaacatggaaattaagtggacttaatgatatgaaagctggagctgcaaggggcttgaaagctatgttaagagagaatca

SEQ ID NO: 81888 - DNA, 201 bp, Homo sapiens
tatccagaaatagtctgtttcctgcaatttgcaaaacatttattcagataatagctttggacaatgtttctcagattttaaattgcatattagtaaaattrtttttttttaagtaatgagactgattttgtagccagtacatttagaactttgaatggaaaatgctcctggcagagcagcagggctgggctggagaagcca

SEQ ID NO: 81889 - DNA, 201 bp, Homo sapiens
tacagaaaagccaaattccttaatgaaatttcctgcttgctgtttacttcatagacatatgttttggagtcatttattgccacacatatctgttttttttwaattcttaaaaacaaaaaagtagttagcatttactttaggctgcattattaacctaattatattaatttgttttttggactacataactattaccttatt

SEQ ID NO: 81890 - DNA, 201 bp, Homo sapiens
aaaaatggcaatagttttgttcagtgtctttaaatatttttcaaccatcataaatgtataaatgattgaattagtagatataatgaaagaaaacttttatraaccagtacttcattatttctatgttcaacccactacatcctatcctatcctatctctttttaaaaatggtaggtgcatctatcatttatttcactatcc

SEQ ID NO: 81891 - DNA, 201 bp, Homo sapiens
cccatattttctgaggcaaaaccatttctgtgctgcaacctggcagattccctcacattagggtacagagacacacttttaataaaacgtttatgttaacrgcgtcttgcaaatatacagtgtccgaattagctaataggagaacataaaaataaactacactgaaacaaagttaagttgaaaaacacaatgtcctatcta

SEQ ID NO: 81892 - DNA, 201 bp, Homo sapiens
gagaggtggtggatcctgtaatatcctcaagacttcccatattttctgaggcaaaaccatttctgtgctgcaacctggcagattccctcacattagggtayagagacacacttttaataaaacgtttatgttaacggcgtcttgcaaatatacagtgtccgaattagctaataggagaacataaaaataaactacactgaa

SEQ ID NO: 81893 - DNA, 201 bp, Homo sapiens
gttgagatcaatgcttttttcatctgctgagatgggaagagctgacctcctgatctcttaaacataagctttggcaccttgaatggttggaagccaagccrtaacatcgctctgtgtacctaggtgaagcctcaggttgtttatatttgtgctttctcctgtgtccacagcttctctggaccctgcctctgctgttcaaaa

SEQ ID NO: 81894 - DNA, 201 bp, Homo sapiens
ttggcactgtaccatattaatttcaagaaggaggaatggtggggtaacattttatttgctatttttataaataatatttaagcctcctcaaaaatgggaasttcactactgctttaaaggtgtgccaagtttttctccaagaacagaagaaacggaaaaatcaagtaaaattttttgcttaagacaatagaaataaacatg

SEQ ID NO: 81895 - DNA, 201 bp, Homo sapiens
gactatgtgctctatgccaagcattgagtttgagtgagcgaatgagacaggcaggaatcacagctgtagtgtctgttctccagccttttaataatgttccscatgtgcctcagtgacctttccagattccttatatttggtttattttaaattttatttttaaaaattgtttatgatgaaaaatttcagacacacatgtgt

SEQ ID NO: 81896 - DNA, 201 bp, Homo sapiens
ctgtatttatttagtcttctttcatttctttcagcagcattttgtcatcttcagcatgtagatcctgtatgtgctttttgagacctgtacttaagtataamttgtaacactgtaagtggtattttttcttggtttctaatatgtgtgttttttcttttggtttctatgtatacaagaagtgtatatatagaaaaatggtta

SEQ ID NO: 81897 - DNA, 201 bp, Homo sapiens
tacttactacgttgtcaaggcagaaatacaggcccctccttctctctttcctctctcaatcctagggcatgctggtcattcttgcccctggagttagttgraggttggccatttttctgttttcccatggatgggtactggttttgtgaggatgggagaagggatagaagtaaaaaagaagtcacactaagtcttgtgttt

SEQ ID NO: 81898 - DNA, 201 bp, Homo sapiens
attcaattaaaactgttacaacatcataaatactcagtgatctctcctccccctacccttttctgataattcaattcagctaacctttcttgagccttatytgaatgtcgtgtgggctagagaatatataaaaactgcctgcatttactgagtgcttctgtctgggaggagattgttcttcctctctctaggcatggggac

SEQ ID NO: 81899 - DNA, 201 bp, Homo sapiens
cagacattgactggcacatagttggtgctcactaaataatatttgaatgaatacattctggacgttgaatgaaaggaccttttgggctctatgcatatctrattcagtggtcatattatttaggggtttagaatgaccatttcacttgttatcaccactatccatgtaatgttttaaaacttatcctcacttggatagctt

SEQ ID NO: 81900 - DNA, 201 bp, Homo sapiens
ataaatgaaacttttgcaacattctgtttttcccttagcatgaaaattttccaactttggctcacataaaaattcatcttctttttctgtaatgatgcttmcccaaaataccaagaagatacctacaggggtatttgtctttttttttttcctggttgccttacatatgatttctcttcccttgtttgggaagttccccag

SEQ ID NO: 81901 - DNA, 201 bp, Homo sapiens
ggaggaaatcacataactgtgctgactgacacaggcaaggattttggtttttaatttctgttggagtctcagcattgtttagcaatctcttgcattctccwaaatggtgattccaaactattactatgtgcttcatctcccatcttctgcaagaccttcactgtcttggttggtcttcctttccagagaaaatgaatctac

SEQ ID NO: 81902 - DNA, 201 bp, Homo sapiens
tataaactttgtctggattgagcttgtgactggtgtttttttcctttgtggacttgattgtggaaatgcatcctgttttgtagggtgaactgcatgtgttrtataaggagacattccttcttcgtgcatattttcagagctttaatgaagggttcacatgatcttgttttagaatattttaatgcgacacatagaaaacaa

SEQ ID NO: 81903 - DNA, 201 bp, Homo sapiens
cttacctgagtcagttatgatggttactaaatggttaattccataatttcttctacgttaattgtttttgaaaaagaaggaagaattttctaaagggagaygtggaattcagaaaatgttttttttttcctccaagggttaagctcttgcaattgaatgcccaacttttaaaactgttgtcttttaaactcaaagccgatt

SEQ ID NO: 81904 - DNA, 201 bp, Homo sapiens
tcgtggggcagcctgccactgccaggactggcctctgggactctcgatttttgtgctccacattcatatgatcttcttcaggaaacctccatcttgttctstctctgtctttgcagtggcctgttgtatgtttattttctgttcaattttcctagaggagtagagttccccccttatccaggttcttgctaacacagatag

SEQ ID NO: 81905 - DNA, 201 bp, Homo sapiens
gaaattagctgctgacacagtttacattggatttgtttatattgttttagtactgcatgagttacttcaaaatgcccgctatatagactacctatgttcayggagcctgagaatgctaggattggcagttgggaatgagaactagaaggtgttgcttttgaagtacataagcaataagattcaaggaacctccttattaat

SEQ ID NO: 81906 - DNA, 201 bp, Homo sapiens
tttttaatgaccttgacagttttgaggagtactggtcaggtattttgtagaatgtccaagagttggaatttatctcatgcttttctcatgattagactgaragtatgtgtttttgggaggaaaaccatggagttacagggtcattttcattacattacatcatattattaacataacattgctattaatgttaactctgtt

SEQ ID NO: 81907 - DNA, 201 bp, Homo sapiens
aaaaaccctgttttactaacacaggaacagataacaaaataccgcgggtgttctcacttttaagtgggaactaaatgatgagaacacatggactcatagargggagcgacacacactggggcctgctggagagtagaggctgggaggagggagaggatcaggaaaaataactaatgagtactaggcttaatacctgggtga

SEQ ID NO: 81908 - DNA, 201 bp, Homo sapiens
tgtaatcccagctactcgggaggctgaggcagaagaattgcttgaacccgggagatggaggctgcagtgagccgatatcgcaccactgcactccagcctgrgcgacagagtgagacaccacctcaaaaaataaaaataggctgggcacggtggctcacatctgtaatctcagcactttgggaggccaaggagggtgggttg

SEQ ID NO: 81909 - DNA, 201 bp, Homo sapiens
aaacattttgtatttttgtatattctagttgaaacatcaaaaaatactagtctggcctatattaaattcatagatcatttactttttgcatcttctgtttygttacggaggtaacacatgtataatctatataagaaaatattggttaaacaaaaaaaattactatcagctaaattctcaacttgtagagataaccactat

SEQ ID NO: 81910 - DNA, 201 bp, Homo sapiens
ctctgaccatttcaatcagattctaactagggcaaagatcatgactgagaagttgtgcgtaatatgtatactcacatcccattggccaaatcttagtcatrtgaccatacacagcagcaaggaaggctgggaaatgagtcttgagttaagtgactgtatgggcaactagaaattatgataccatgtcaaaagaaaacagac

SEQ ID NO: 81911 - DNA, 201 bp, Homo sapiens
ggtgtgtagtacactctaccatctaggtttgtgtaagtacacccaatgatttttgcacaatgacagaattgcctaatggtacatttcttagaacacatatycctgtcgttaagcgacacataactgtaatttgtctactttattaacaaaagcttagataccagtaagaattaagggatctgggtttcattctggttttgt

SEQ ID NO: 81912 - DNA, 201 bp, Homo sapiens
tccaaatgttaacaaatggataaattaaaatacttatataatactctgaagattgtagcaagagagaagactacatacctgcttaagatgagaaatcgccrtgtgtttctatagcttccagatcctcttttttaacaaggagaaagaacttccctgctcctcaccaatggcaaagcgtctaaaatcactgagtactcacta

SEQ ID NO: 81913 - DNA, 201 bp, Homo sapiens
ggatggtgtctgggttcgggaggacgcttgtgtagcatcatggcctggggatggcggggtggggggcggggtggcgcgtgaatctggtccttgctgttctstcagaggcgtatcttgtcctgcttggtctgtggatatgggaagccagctggggcatctgctgacttgtagctggtcccatttagcctttgtcatctgcca

SEQ ID NO: 81914 - DNA, 201 bp, Homo sapiens
atttatttgacaaataatagttgaatatatttatagggtacagtgtggtcttttgatatgtatatatattgtagaaagattaaatcaagctgataaatatrtatccatcacttcaccttcttatcatttttttttgtgatgagaatatttaaaatctattcttctgtgttccttcagtttttgtttcatcttcatgaaaac

SEQ ID NO: 81915 - DNA, 201 bp, Homo sapiens
agatgagaaaactgaggcttagagaagtaacttgcccaaagtcacacacctgctctgaggaggaaataatgcacttttcattcattagcgctttcaccagrtgtcatatttatctattttttacagatggttaaaagaataatatggaaatttgagttgcttgtcattttgcattaaacattgtgtgaaaatcacatcaat

SEQ ID NO: 81916 - DNA, 201 bp, Homo sapiens
ttgtccgtcagcgtttcagaggagttcagctttctaaatctatgcttttctggtatttgatgtttgtatgtatgagagagagagagagagagagaaagaargaggagggaggggaggggagggtaggaaggaaaaaggggagggaagagggagacagaaagaaacacagagtaaaattatttctagacttgcactgcaaag

SEQ ID NO: 81917 - DNA, 201 bp, Homo sapiens
agagtatagagtcaagcttttgatctagtgggagaggctgagactgatcgaaaatataaggcagaaataaatgacatgagagaaatagaaataaagtgctrtatttgatcaaaatagagaacagttatagcagagcgatttggaaaggctttgtggaaaatgtgaaatcagaattgagccttgaggaatgagtagggtttc

SEQ ID NO: 81918 - DNA, 201 bp, Homo sapiens
cctcagcctcccgagtagctgggactacaggcgcccgctaccacgcccggctaattttttgtatttttagtagagacggggtttcaccgtgttagccaggwtggtctcgatctcctgacctcgtgatctgcccgcctcggcctcccaaagtgctgggattacaggcgtgagccaccgcgcccggcccttagacttttctta

SEQ ID NO: 81919 - DNA, 201 bp, Homo sapiens
tgcaaagcaccatgccatttgtatgtgtgtctgcgttggggaggagtcgatgggtataaaagatagaaggtttgcatatgcctaaaaaaatgagacctgcragtctctattaacactaattcttgggataagccgaattttgacttaaaacattttgatattcacctgtattatttgatgttttttctgcatgggcaagta

SEQ ID NO: 81920 - DNA, 201 bp, Homo sapiens
tttgccatccgtacatcatctggggtgatgtgtgtgtccaaatcctttgttttcttgttattgagtcttgatacttgtttatatattctggatatgagtcctttgtcagatatgtgttttgcaaatatttgctcctagtctttgggttttgttttccttgtcttaacatcttttgaagactacaagttttaaattttgatg

SEQ ID NO: 81921 - DNA, 201 bp, Homo sapiens
cttgtgtacaagtttttgtatggatgtatgctttcatttctcttgggcttatacctagaagtggaattgccaggtctatggtaaccttctcaggaactgcyagactgtttctaaagctactgcaccattttccattcctgccagtcgtgcatgaaggttccagtttctcctgtttctctttgtctttttaaaatttagttc

SEQ ID NO: 81922 - DNA, 201 bp, Homo sapiens
taacctctatgtaaaagccatttgctcttttttctctttgttttcttttattgcttttagtattacttctgatttcatgatatatctccgatatcatagastacatttcaaatctaaatgtatacctttatatttttcttaatataaagcactgggtcttaaataagtattagcttttatacttagcaataagaaaaaaag

SEQ ID NO: 81923 - DNA, 201 bp, Homo sapiens
taaaaaatacttttttatcagattcagaaagaagtccttaaaacatattttccactaaacattttaaagatatgcttctgatattttaagtccttaatccrtctggagttaatttttgtgtaatgtaaaatggaggttcagttttcatttttattcacataaactcaccatctctgtcatatattaaagttatgcatatgt

SEQ ID NO: 81924 - DNA, 201 bp, Homo sapiens
acacataccccaaatgcttaccttcccccatcccaacacacacacacacacacacacacacacacacacacacacacacacacacacacagacaccccttycccctcctcctttcctctcttcttcaatctccttccctctcctctccttccttcctcctttttttgtctttttacaaaccaggatcatattctacataca

SEQ ID NO: 81925 - DNA, 201 bp, Homo sapiens
gaaaaattatgcatacaagcatagttaacacttggtcatgatcctgtctgaggttttccctattcacacataccccaaatgcttaccttcccccatcccawcacacacacacacacacacacacacacacacacacacacacacacacacacacagacaccccttccccctcctcctttcctctcttcttcaatctccttc

SEQ ID NO: 81926 - DNA, 201 bp, Homo sapiens
agattctgtgtcccaatttttgggttcaggaaatctattcatcctttgcagatgctcaagaatcgttgtgtaactggattcttctgctgaatttatatggrgacctatgggctgcatagtggagtagtgaaagccttgtatagacactggggtgggcaatctttcctctgtgctcaaggccataggacatcccttcatatg

SEQ ID NO: 81927 - DNA, 201 bp, Homo sapiens
acctgagactgggtaatttataaagaaaagaggtttgcatggttccacaggctgtacaggaagcatggctggggaggcatcaggaaacttagaatcatggyggaaggtgaaggggaagctggcacatcctacatggttggagcaggagagagagagagtgaaggaggaggtgctacacactttcaaacaaccaaatttcat

SEQ ID NO: 81928 - DNA, 201 bp, Homo sapiens
tggtgacttatgctttttggttttgatgtgaggggccagggtgatccatcatcccacaataataatgtcagtgctttcctgagtgagcccaaactcttttrcagagtttgaataatgttgagatcaatgcttttttcatctgctgagatgggaagagctgacctcctgatctcttaaacataagctttggcaccttgaatg

SEQ ID NO: 81929 - DNA, 201 bp, Homo sapiens
cactgtcccaagtattttacagatactaaagtatttaatcattgcaactgctccatgagataaataccacagtcctcattttatagatgaagaaatggagygaaagagaggttgactaattccttgaggttatacagctagtaagtggaggaggtaggattcaaatggttaacatttaataactatgctattactgccttt

SEQ ID NO: 81930 - DNA, 201 bp, Homo sapiens
gttaactcttacagctttgtaataattactgatatctgatagtggctcttccatattgtttgttttcaggactgtcttaactatccttggctttttgctcytctgtatgtatttttttttttttttgagtcttgctcttttgcccaggctggaatgcaatggtgtgatcttggctcactacaacctctgcctcctgggttc

SEQ ID NO: 81931 - DNA, 201 bp, Homo sapiens
tgagactccgtctcaaaaaaaaaaaaaaaaaaaaaaaaagaagtaggaatggtagggaagtgtaaggaggctcttggccagtcattgtagtggtaacgatrgtacattgtgaattcgatgtgataaatgaaatgttttggtttgattggttttgaaaactgttggtacttcctctcactccatatctgccaatccaaggcg

SEQ ID NO: 81932 - DNA, 201 bp, Homo sapiens
acaggtaagattctgaaccatgggaaggccctaagaaatcttacaagcatccaggcccaaattagaataatcttattttacctataaaaatggaagctgarttcagatatctttcttgcaataaaggaaaaatatagtaactagggattacatattgcttctgttattgttttgtgaagacaacagaaagacattcttaga

SEQ ID NO: 81933 - DNA, 201 bp, Homo sapiens
tgccttggcctcccaaagtgctgggattacaggcatgagccactgcgtctggcctatatgtgctttagatcagttttttaagttctgaaaaatccggttgrggttttgattgaaattgctttgactttacagattaatttggggagaatttctaactttgtgatattaaatcttgtcatgtattaatattgtatctcagtt

SEQ ID NO: 81934 - DNA, 201 bp, Homo sapiens
gtcttggggtacgctgaagtgtgctatccatctagttatgttttgtatattctttattcccccatgtgaaacccagccgcagaggaaggtctgctaagttsctttataccaatataaatgacaggcagaacttgtgtgacttctcccagaaatgttagcattttcacaggacggaaggccttaaggattaactggatattg

SEQ ID NO: 81935 - DNA, 201 bp, Homo sapiens
tgaaaatttcaacttgaagacagagagaatttttctccctagtatttttcctttgtatcctcttattcctttagtgtcgacatattaagatatgagttgayagatttttgttctggagaaattgcttctgcaaggtgggtccactccagacagacctggggaggggacttcacaaaaaaggcgaggaagaaggaagaagca

SEQ ID NO: 81936 - DNA, 201 bp, Homo sapiens
ttatagctattgcttcttaactggtctttctgcttccactcttgctgtcagtagttccagttttaaaatacagacctgatcatggtgtttctttgattaargtcttgttttctccagccccttcctgctcacagaggttagttgatcctctctggttcccatggtgcccagagcttaccagcactcttcacaccttgttaa

SEQ ID NO: 81937 - DNA, 201 bp, Homo sapiens
cactccagcctgggcgacagagcgagactctgtctcagaaaaaaaaaaaaaaattaaatcgggtcgggttaaggatgttcccttctctatacttaatttastaaagtttatatcagggatttatataaaattttattaaatgcttttatgaatctatttatatgacatcctttttctcctttaaacttttaatgtgttaaa

SEQ ID NO: 81938 - DNA, 201 bp, Homo sapiens
ttcagctcagaaaattatcttatattatttcttcctttccatcatctcttttttctccttttgggaggtatcagttgagaatgtgattggctgccagtaayagtggcttaaacagtaaagagtttacttttttctagtaacaagaaatccaggagtgagcagctcatgtctttctgtcctcctgttctacattcctatgcg

SEQ ID NO: 81939 - DNA, 201 bp, Homo sapiens
attttgtcattctgttttattttgaaactatttactttatgaagctttccatatgaatatttattttcactatgaaaaaatttaaacaattgggagtttarttattacctctgtgacattctagtacttcctataaataagtgcctgaacgaatggatgaaaaaatagttcataatcattcatgcaaataacaatattgaa

SEQ ID NO: 81940 - DNA, 201 bp, Homo sapiens
ctttccttccacctcacactgcttattgactggagttccccctacattacaaagcacctaataagatgatcttttcctatcagcattaaaaatttttttttcgactttgtagaaaataatcgttttgcagcacttaaagagaatcacttgcgggcattctgtaaaattttacattttactgacagcacaaaacaggaaatt

SEQ ID NO: 81941 - DNA, 201 bp, Homo sapiens
cttttatcggataacaggctttgctgtgttatgtgatgggattaaactgtttatttaggatgtagaattgaagacgtggatgatgtgttattttttttccyaaagtgctctgtattttcttcagccagagtgtatttcagaacttcataatgaccttttataatttgtaaaatggtgtctaatgtttaggtccttttggga

SEQ ID NO: 81942 - DNA, 201 bp, Homo sapiens
aataatgtcacccaagtcttgaggaatttgctaattgtttgtagatcctacaaggtcataatctagacctgttttaaaaaatcttttaaaacttcaatatrtttatttgaaagggatgaagaaatgatatacattctacccagtctgcaggattacttgacacttgccgtcataggctgggactcaagaagtattagaggc

SEQ ID NO: 81943 - DNA, 201 bp, Homo sapiens
ttcttttaggtgtgtattttgtgaatgcatacgattgcatcgactggtctgattttatcagcagtgactagtctgtctacttctactttgtattcagagasattacctataagcagagttggtagcttcctaccaatatagttccatggatgcttggcaggccccttagcctaataatatgcctctcttctgattcctagt

SEQ ID NO: 81944 - DNA, 201 bp, Homo sapiens
gcacttgtgttctagattatagctattgcttcttaactggtctttctgcttccactcttgctgtcagtagttccagttttaaaatacagacctgatcatgrtgtttctttgattaaggtcttgttttctccagccccttcctgctcacagaggttagttgatcctctctggttcccatggtgcccagagcttaccagcact

SEQ ID NO: 81945 - DNA, 201 bp, Homo sapiens
taggagcaggtgaaggtgttgctatgcctggggctgatgaagtaggggaaaggggtgggtgagggaaactgctaaatgcccacataattctgagatatttyagcttcgctggttcatggtatagtcatgtgccacataatgatgttttggtcaacatgcatacatgacagtggtcccataagataataatggagctgaaaa

SEQ ID NO: 81946 - DNA, 201 bp, Homo sapiens
tacctgcttaagatgagaaatcgccgtgtgtttctatagcttccagatcctcttttttaacaaggagaaagaacttccctgctcctcaccaatggcaaagygtctaaaatcactgagtactcactaattcctctgaccactcacatatctcctgtcattctcctagaattgaatttctggttctccagtgttgctccattg

SEQ ID NO: 81947 - DNA, 201 bp, Homo sapiens
ttaatttttctgaaatgtacttatagcccacatttatgtgagttttaatattacaagtgttttggtctttatttagaagtttaataatgtttttgtttccrgaaatgtgccacagaaacttaattcttatttatattaattagactatggtaaaattggtttccttatatgtcattttgcttaaagtcgcagtttccaaga

SEQ ID NO: 81948 - DNA, 201 bp, Homo sapiens
tgcagctctcccattctcagcttggcatggtgtaggccttaatacttgtgaactactgaagctatgtttctatgtcttttaaaaaaatatcttctagtggyagtgattgaaaaacagacagtggttcttattagcaacaacagtgcttcagaaatttgagtggaatgctgaatttggtattggatcagatgggtgacagga

SEQ ID NO: 81949 - DNA, 201 bp, Homo sapiens
tagaaatgaaaatataatgttaagtggacattcttggagttagaccttccttgatcctttaaacaggatcctggcccttacatctattttcccttcatcaytctatagcttttttaaagctttgcaccatccctctagtgagaacaacatcagtttttcaaaccagtcagagaaaagttgttatatgtttctctagaatag

SEQ ID NO: 81950 - DNA, 201 bp, Homo sapiens
ttgaaatgaaaccagatagaatttgtagaaatgaaaatataatgttaagtggacattcttggagttagaccttccttgatcctttaaacaggatcctggcmcttacatctattttcccttcatcattctatagcttttttaaagctttgcaccatccctctagtgagaacaacatcagtttttcaaaccagtcagagaaaa

SEQ ID NO: 81951 - DNA, 201 bp, Homo sapiens
tatttggttattttgcactgaaaattaaatctaaaatgatttaatgatgagaatggtaactttgagagatttttgcattattcactttggagcaggaatayttagatacgtgggcttcatgactgtattttgggtttttaagtcagaaaactaggaaggtttataaaaacctttggaaaatatctgttgcatgctaaacta

SEQ ID NO: 81952 - DNA, 201 bp, Homo sapiens
gactgcagattgtggtggagagttgaacatgtggtgcagagaaaacacaaaacctacagagggctgagagcagatgggctggaggagacagtctctctgtkgggaggggaaaggtgcttctttgagaaagggctgactctctctctttaaggtctttcctgtctcccttgggctgtgttaacttctgaagtgattttcatc

SEQ ID NO: 81953 - DNA, 201 bp, Homo sapiens
ctagggacacagagattcagagcgtagttttttttgctataagtctaaaagcagtgcatgtgcagtgatccctgtggcccacgggggaggagggtgtgccygtccagtgggaggtaacactcaatgtctgctgcatggaaatcccaggccaggcctgcctggatcctccagtttttcaagggaagctagaaattcagattt

SEQ ID NO: 81954 - DNA, 201 bp, Homo sapiens
ctgtgaataacatagaaataaataaatgaccaaagcacagggttctgattaggagactctccctagaaagcacatctcaactcagactatccacttttcawccattctgtagccacatgtggcaagtggctgtcgtattagacctttgactgcccatcccagtgtgagctcaaggagcaggcccgtctgccttatcccaga

SEQ ID NO: 81955 - DNA, 201 bp, Homo sapiens
ttttcggaaactgttttttttttgaaattatttttaggtcgatactgcaagcaacttgaactctggtaaagaggaccactccgaaagcagtaatacagagracagaagaactagtaatgatgataagcaggaaagctgctctgagaaaataaaattggctgaagagggatcagatgaagatctggatttggttcaacatca

SEQ ID NO: 81956 - DNA, 201 bp, Homo sapiens
aaaagcaattataactctttttggactgtagccgaatctgtgcaaaactcatatttttaaaatttccatagcaccccaaatttactagagcttcacatacrtggtctttttgagctgcacaagtcttgtaagaagggaattattattgttcccattttacggaggaggaaactgtgctcggagaggataactgacctgtaa

SEQ ID NO: 81957 - DNA, 201 bp, Homo sapiens
cagtttttcttatcctcttatttaagagttagcttcaggttgggtgggtggttcatgcatgtaatcccagcgctttgggaagtggagtcaggaggattgcstgaagccaggagttcgagaccaacctgggctacttagcaagaccttgtctatacaaaatatttaaaaattagccaagcatcaggaggctgaggtgggagg

SEQ ID NO: 81958 - DNA, 201 bp, Homo sapiens
tgaaacccaatgcatgggcaatgttcagaatctgttggtttcagcccaggattgatagttgcagtgcaatttcagccattatgcgcaagcagtgtcacatycattcagctgacaggggcgagacactaatctcagtgggcatccagcaactgaaactgcagctggccttgggaagtttctgccaactctttaaatctttac

SEQ ID NO: 81959 - DNA, 201 bp, Homo sapiens
ccccttacctaaatgtgagattagctctctggtgcagtgtgtcctccatagcttccccagggatcagactgaagctgagcttcagctgagaccacatcctygcttggccctgtgcccttgccctcggctgttttcctcatgtccctggtcccaaaggcactctcccagtgaattacttgaacaagaatccttgtcttagtt

SEQ ID NO: 81960 - DNA, 201 bp, Homo sapiens
acctagaaaatgtaaaatgcctaatcttgcaacttttctttgtgtatctgtagtgtagaagtctcagattccattttttttttcctgaactgtgaatttcyttgagtatatgatattttccattaataaattctgtagttggccaaggaatcaagaaacccagtggttatggttgacagagagaagaaaaggctggttgag

SEQ ID NO: 81961 - DNA, 201 bp, Homo sapiens
ttggtataaaataaaattacctagaaaatgtaaaatgcctaatcttgcaacttttctttgtgtatctgtagtgtagaagtctcagattccattttttttttcctgaactgtgaatttctttgagtatatgatattttccattaataaattctgtagttggccaaggaatcaagaaacccagtggttatggttgacagagag

SEQ ID NO: 81962 - DNA, 201 bp, Homo sapiens
gccctactcccagatgtgtaactaaacttagatcccagaatgcctcaagacaccaatgacaaagtcaaaggtaggaggtgatagcttatggtgctaaaaakttgcaagactttcccaattgatactggaaaatattctgggggaatatgtatgataatggattttgaaagttttaggtcaaatagagaaaaataccacttt

SEQ ID NO: 81963 - DNA, 201 bp, Homo sapiens
agcttccactcctgcaagctccactcatggttaagtgccctttacaggtatgccattaaaaagatttttataccatattttattgtaccttttctatgttktaatatgtttagattcacaaatacttcctattgtgttaacaatcacctacaacacagtaactacaaaacatactgtacaggtttatagcctaggagcaat

SEQ ID NO: 81964 - DNA, 201 bp, Homo sapiens
aaaagcttacaaagaaagaaaatatttttgtacagttctatactgtgtttatgttttaagctaagtgttattataagagagcgaaaaagttaaacaaattyaaaagttttaaaagtaaaaaagttacagtaaaaattcctttattattaaataaagaaaaatattttaaaataaatttagtgtagcctaagtttacagtgt

SEQ ID NO: 81965 - DNA, 201 bp, Homo sapiens
taaagcataggtttatttgcctatataagctataagcttatataacttaataacttaagttataagcttatataacttaaatttgagtaaaatttttttttactcaaagctacttctgtttgaaaagaattttaatcaagagatcttactctttctctcgttctttccagctattttcatcaaaaaaattttaaatggtta

SEQ ID NO: 81966 - DNA, 201 bp, Homo sapiens
tgttctccttcaagccacaggctggccagctgtggggaactgtgtgtgtgtgtgtgtgtgtgtgtgtgtgtgtgactgagggggagagagagagagagagmgacagacagacagacagacagactacttcagcctctgtctccctgtaagcatgccacactgcctttgcttgtctgcagctgtcatgggtggttggagagc

SEQ ID NO: 81967 - DNA, 201 bp, Homo sapiens
atatgtctgtttaatatatttaaagaaataaaatgagctttgagaatatgacaaagatttgaaatgaaaccagatagaatttgtagaaatgaaaatataaygttaagtggacattcttggagttagaccttccttgatcctttaaacaggatcctggcccttacatctattttcccttcatcattctatagcttttttaaa

SEQ ID NO: 81968 - DNA, 201 bp, Homo sapiens
tctgttctccttcaagccacaggctggccagctgtggggaactgtgtgtgtgtgtgtgtgtgtgtgtgtgtgtgtgactgagggggagagagagagagagmgagacagacagacagacagacagactacttcagcctctgtctccctgtaagcatgccacactgcctttgcttgtctgcagctgtcatgggtggttggaga

SEQ ID NO: 81969 - DNA, 201 bp, Homo sapiens
tggggacatatataactgtctctgctttggttgtgggaggaatggaaaagagaagtcccccatgagagttaccaacgataagcctgcatgaaggtaggctytgggtttgagttcataccacctgtagggccaagttgaatgttcagttgaaaatggtcttggattggcagtaatcccagctcctggtagaaggaaagggaa

SEQ ID NO: 81970 - DNA, 201 bp, Homo sapiens
ttcttcacaggggcatgtgagagcttctgttctccttcaagccacaggctggccagctgtggggaactgtgtgtgtgtgtgtgtgtgtgtgtgtgtgtgtkactgagggggagagagagagagagagagacagacagacagacagacagactacttcagcctctgtctccctgtaagcatgccacactgcctttgcttgtc

SEQ ID NO: 81971 - DNA, 201 bp, Homo sapiens
cttcttcacaggggcatgtgagagcttctgttctccttcaagccacaggctggccagctgtggggaactgtgtgtgtgtgtgtgtgtgtgtgtgtgtgtgtgactgagggggagagagagagagagagagacagacagacagacagacagactacttcagcctctgtctccctgtaagcatgccacactgcctttgcttgt

SEQ ID NO: 81972 - DNA, 201 bp, Homo sapiens
tgaccattggaacaagcattggtccccgtggtatctgttaacctctaaaggcctaaagtgtgggttttaaccaggcatgtgtagggagcacaggaaacagmgcccaagacagggtaaaggtcaagtcagagctcccacatagagtcagcacaccaaatggttaaccccgagtggaaacactaggaagaatctgctctggag

SEQ ID NO: 81973 - DNA, 201 bp, Homo sapiens
gttctttcctgtgacttactcctctagtttcacaaatgtcatatattttgatatattgaggatgccaacaagtttttagaaattttatgatttttttatarttattttcaaaatgtctgctgtcccattgattaccaggatgctgtttcatttgtttttcattttttttccttctgtgtcttcttatcctccaatgaggta

SEQ ID NO: 81974 - DNA, 201 bp, Homo sapiens
agccacccatgttgattctaaaatgagggcctgaactttgcttttgtgctctagtggtgggtaatatgctgacaccacagctcagatgtagagaacaattyttgctttcctctctctggagaatgacaggaattaaaaaaacattttttttttcagtttgaattaggcatagaaaaattttgtatttgtaatgtgttagct

SEQ ID NO: 81975 - DNA, 201 bp, Homo sapiens
ttaggtgaggcaatgagtgtactcttttgaactagcctgttaaaagatacactctcacgttggttttcttatcatctctccttatttcactcagttcccccttcttccccctttatttttataatcccatcctcttgtctttttatattcatcagttctttcctgtgacttactcctctagtttcacaaatgtcatatatt

SEQ ID NO: 81976 - DNA, 201 bp, Homo sapiens
aatggaaggagggaaggagggaaggagggaaggagggaaggagggaaggagggaagcccaaacaggaaaaccattagggtctaacaggaaaatcactaatrtgtctagtgatgtacatgttaggtgaggcaatgagtgtactcttttgaactagcctgttaaaagatacactctcacgttggttttcttatcatctctcct

SEQ ID NO: 81977 - DNA, 201 bp, Homo sapiens
gattcctggtgtgtaattttcttttttgtgttgggtctttgtgtggctcaggtatcaaggtgatactggcttcataaaatatgttagaaagtatcccctcyagcctggtttttttttttttggaagagtttaagaagtattggtattaattcttcttggagagtttggtggaattcagccatgaaaccatctggtcgtggg

SEQ ID NO: 81978 - DNA, 201 bp, Homo sapiens
atacagaattagccaggcttggtggcgggcgcttgtagtcccagctacttgggaggctgaggcaggagggagaattgcttgaaccggggaggcagaggttrcagtgagccgagattgtgtcactgcactccagcctgggcgacagagcaagacttcatctcaaaaataaaaagaaaaagaaattatagaagagagagagag

SEQ ID NO: 81979 - DNA, 201 bp, Homo sapiens
agagatggggtcttgccatcttgcccagtctggccttaaactcctgagctcaagagattcctcttggcctcccaagtgccaggattacaggtgtgagccaygccaggctctgtcattttattataacattgatgaaaaaaaaatggattcccagctagggccactgtctgtatggagtttgtcttccccctgtctgcatgt

SEQ ID NO: 81980 - DNA, 201 bp, Homo sapiens
tggtggaaggctctatgccaccccctcatcacgaccccagtcttcttcacaggggcatgtgagagcttctgttctccttcaagccacaggctggccagctrtggggaactgtgtgtgtgtgtgtgtgtgtgtgtgtgtgtgtgactgagggggagagagagagagagagagacagacagacagacagacagactacttcag

SEQ ID NO: 81981 - DNA, 201 bp, Homo sapiens
ccaatctgtattccctcaaacagtatacaagggttcccttttctccacaccctcaccaatagttgttatctcctgtctttttgataatagctttcctaacragttgttatctcacagtagggttgatttacatttccctgatgattagtgatgttgagcaccttttcatattgttggtcatttttatgttttctttgaaaa

SEQ ID NO: 81982 - DNA, 201 bp, Homo sapiens
ctgttctccttcaagccacaggctggccagctgtggggaactgtgtgtgtgtgtgtgtgtgtgtgtgtgtgtgtgactgagggggagagagagagagagasagacagacagacagacagacagactacttcagcctctgtctccctgtaagcatgccacactgcctttgcttgtctgcagctgtcatgggtggttggagag

SEQ ID NO: 81983 - DNA, 201 bp, Homo sapiens
ctgtctgcatgtgttttctccagacactccagtttcctctccatctcaaagatatgcatgttaggttatctacgtggttccactgtgagtgagtgtgggtktgtctgagggcaccctgccatggcatcctgtccagggtgtgttcccacctgggactctgagctgcacagatagactctggccacttgagactctgaatta

SEQ ID NO: 81984 - DNA, 201 bp, Homo sapiens
ttttggattccacatataagtgagatcatgatcatgcggtatttttctttctgtgtctggcttatttcacatagtattatgtcctccaagtctacccatgytgtggcaaaaggcaggttctccttttttaaggctgagtaatattcctgtgtgtgtgtgtgtgtgtgtgtgtgtgtgtgtgtttatgtattacagttgctt

SEQ ID NO: 81985 - DNA, 201 bp, Homo sapiens
ctctgtgctaggtatgggaacacagagatgaggaggacctggtgccagcccgaggagcttacatccagcagggaaagtagatgcagagggtactgggatgrcacagcctgatgccccaggtttgggagacacagagggcagccgccacccactggtgagggattcttgtttatacacttgcctcagatttatgagttgaga

SEQ ID NO: 81986 - DNA, 201 bp, Homo sapiens
ggatttttttgcttacttatacagctggttactatgcgatgagaggcaaatgacaggcatccagggaagtcgtgtgtttttacccattggtgaaattgacrgtcaccagccacccatgttgattctaaaatgagggcctgaactttgcttttgtgctctagtggtgggtaatatgctgacaccacagctcagatgtagaga

SEQ ID NO: 81987 - DNA, 201 bp, Homo sapiens
ggaagattattcttttaatttagtaccagatttaaatgaatgaatttattcagattttttgcatctatatttataagcaaggttagttgtgtttgtgtgtgcacacacaggtgtgtgaaatgtttgttatggtatagggggtgaagttgagggtggagagtcgatgtatgtgtgtttgctttgtcaggctgtgtgaacttc

SEQ ID NO: 81988 - DNA, 201 bp, Homo sapiens
ttattattcagttctattttcacagcagaccaaattaaacctctatgtcagacttgtagtgaatatcacagcagtaggcccagaatgcaggctttttattrcgcttgggcatttttgcaaatctgaagcattttttccatggtgagtggacatgaagtctgggaagaggtgtcttcgttacttcgcctctgcctgtaggtg

SEQ ID NO: 81989 - DNA, 201 bp, Homo sapiens
ataaacagtttcgaggatttttttgcttacttatacagctggttactatgcgatgagaggcaaatgacaggcatccagggaagtcgtgtgtttttacccaytggtgaaattgacggtcaccagccacccatgttgattctaaaatgagggcctgaactttgcttttgtgctctagtggtgggtaatatgctgacaccacag

SEQ ID NO: 81990 - DNA, 201 bp, Homo sapiens
tgattgatttacataagttaaaccacccttacctgccagggataaatcccacttgatcatgatgtgtagtctttttgatatattgttgaatttggtttggkaatattttattaaggatttttacatcaatgttcatcagagattcctggtgtgtaattttcttttttgtgttgggtctttgtgtggctcaggtatcaaggt

SEQ ID NO: 81991 - DNA, 201 bp, Homo sapiens
ttgtcagattgctcttgctggtccttccagtactgtgttgaatagaagtgatgagagtgggcatccctaccttgtactagatctcagaggaaaagctttcygtttttcccccttggttatgatgttaactgtgaactttttataaatggccttcaggaaattttcttctatacctaaactcttgagagtttttatcaagaa

SEQ ID NO: 81992 - DNA, 201 bp, Homo sapiens
gatgctatcataaatgagattgttttcttgatttttttaggctaggttgtttgtgtatagaaatgccacagattttcatatgttgattttgtactctacarcttttctgaatttatttattacttctaatagtttttttctggtggaatctgtgaggttttctacatacaaaatcatgtcatctgcaagtagagataattt

SEQ ID NO: 81993 - DNA, 201 bp, Homo sapiens
tcctccaagtctacccatgttgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggagt

SEQ ID NO: 81994 - DNA, 201 bp, Homo sapiens
gtcctccaagtctacccatgttgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggag

SEQ ID NO: 81995 - DNA, 201 bp, Homo sapiens
tgtatatgtgtgtatatgaaggagtcatggggtgatatttttctggaacctgagaagaaaacttggtctgcaacattcagatttcaagcactgcgctggcrtgttcatctccccagggacaggcccagggtaccatgtctcttaccagcagcaggctggtaaagtgctgggcccctccatctctggaataggaaggggtgt

SEQ ID NO: 81996 - DNA, 201 bp, Homo sapiens
gtggttcatgcatgtaatcccagcgctttgggaagtggagtcaggaggattgcctgaagccaggagttcgagaccaacctgggctacttagcaagaccttrtctatacaaaatatttaaaaattagccaagcatcaggaggctgaggtgggaggattgcttgagtccacgagtttgagactgcagtcatgccattgctctg

SEQ ID NO: 81997 - DNA, 201 bp, Homo sapiens
ctgcttagataagtaggatccaagattaagaaaaaaaatggaaagaaatgtttaggtagatgaaatcttttgattaatcacccgaaatgtgcaaaatctayagcaaatttttatttcaacagctcttagtcctatatatataagttgaacttgcttctataaatacagatgcaagttcaaaatataactaacaaagtactg

SEQ ID NO: 81998 - DNA, 201 bp, Homo sapiens
cccagtccagtctgcttggtgtcgacaaacatctttttagggttcaaacctattcatgtcttcccctctctgtgtacagatgttttcatctggcattcagmgccctttgaaatacacacagctgccctttcagcctcatctaatcaatagttgccattctagttatgtgattctatattgaattcttcctgaacacttctt

SEQ ID NO: 81999 - DNA, 201 bp, Homo sapiens
cccaggagtttaaaaccagcctgggcaccatagtgagacccccatctctacaaaaatttttttaaaaaattatccaggtatggtgacatgcacctgtagtmctggctctggctgttcagaagctgatgtgggaggattgcttgagcccaggcgttcgaggttgcagtgagctatgatcatgccaccacacttcagcctgag

SEQ ID NO: 82000 - DNA, 201 bp, Homo sapiens
atgagtgcaaggttttattgagtggtagaggtagctctcagtgagatggatggggagctggaacggggatggagtgggaaggtggtcttcccctggagtcrggctgcccagtggctgaactgtcctctgactgcctctggctgaactcaccttcgcatctgcatcgttccgtagtcactggtttgccagtgtctgctggtg

SEQ ID NO: 82001 - DNA, 201 bp, Homo sapiens
aatgctagtgtatgcatttatgtacattctccatctgcttccattagtgtcaaaatattctagaaatgtaaagtttaaaaaaagacagtattttcggaaaytgttttttttttgaaattatttttaggtcgatactgcaagcaacttgaactctggtaaagaggaccactccgaaagcagtaatacagagaacagaagaac

SEQ ID NO: 82002 - DNA, 201 bp, Homo sapiens
caattcgacatgagatttgggtggggacacagagtcaaaacatatcagatattatctggctgtgaccttattttttttttcttcagcagtcccttttttttccttaaaatatctagacttctagacttgatttttttacttaaagcattagttttctcatttatttcttttaaggttttaggaaatgaataattgaacatt

SEQ ID NO: 82003 - DNA, 201 bp, Homo sapiens
atctgcccacctcggcctcccaaagtactgggattacaggcgtgagccaccacacccagtctctttcatcttttgataatagttgttataacaggtgtgaygtagcatctcgttttgattttaatttacattttcttaatgattaatgatgctaagtattttttcatgaacctgttggccatttttatgtcttcttttggg

SEQ ID NO: 82004 - DNA, 201 bp, Homo sapiens
gtttggctttatcaatttctggacagtctctttgatttcctgtggtaacagattacatttctgatactactcgcttccttttgtgcactcctcacgaacaytcaatataattaaggcataatatttggttaaatcaacattcaatgcttacgtaattataactatttacatattgattgcttttttcttgtacaatgcttt

SEQ ID NO: 82005 - DNA, 201 bp, Homo sapiens
aaatcaacattcaatgcttacgtaattataactatttacatattgattgcttttttcttgtacaatgctttatttttcttgtggaatttctttgtggcagwtgcaatttcttctcaaatgcttaaatacatctataagatccaattttaataccctttaccaatacctttttctagatggccaaattcataagatagtctg

SEQ ID NO: 82006 - DNA, 201 bp, Homo sapiens
ggagtgaacctaatagaacagacctatttctagagcaaaatgaaagatttgtggagctctttagctgatccaggtcattgttggttgcctgtgcctgtgcytttattgacatgtattatgcggttctgcgcatgcttccatctcattgctccctctgcaagctgtaataagtctcccttgacaggctgcttagggcgttta

SEQ ID NO: 82007 - DNA, 201 bp, Homo sapiens
tttgcccaggctggaatgcaatggtgtgatcttggctcactacaacctctgcctcctgggttcaagtgattctcctgtcagcctcccgaatagccggggcyacaggcacacaccaataggcacacctaatttttctatttttagtagatatggggtttcaccatattggccaggctagtcttgaactcctgacctcaggcg

SEQ ID NO: 82008 - DNA, 201 bp, Homo sapiens
cattttttatgctggtaaattaattctagtcagattgaattagaatagtgtttctcaaaaagtggtctgcagagccctgggggtatggtgggagatggtgkccctgagacccttgcaggggctctgcaaggtaaaagctgttttcatagtaatgctgagatgctatttgcctttgtgtccaccatactgacatttgcactg

SEQ ID NO: 82009 - DNA, 201 bp, Homo sapiens
aagtggtctgcagagccctgggggtatggtgggagatggtgtccctgagacccttgcaggggctctgcaaggtaaaagctgttttcatagtaatgctgagrtgctatttgcctttgtgtccaccatactgacatttgcactgatggtataaaaggaatggtgggcaaaattgctggtgctttatcatgaatcaggacaatg

SEQ ID NO: 82010 - DNA, 201 bp, Homo sapiens
ggtagtcgctagtctccttgactccaaaacccacagtcataaccgctgcttatgcaaatgctattcccccaggtctttatctcttcctatattttctggakgcaggaaagtttgtggaacctgtatctggtgagacctggtgggtaggtgactctagttggattctctgtgctctttgggaaggctagctccctgctgagg

SEQ ID NO: 82011 - DNA, 201 bp, Homo sapiens
gcatccaggcacaattcagacatacaagatacttcagttcagtggtttcttgaattacacctaaaatccaaaggaacgtgtttctgaaagtggctgccaatttttttttttaagaggacaatcagcaccatctagtggacacaaatatctcctcttctagaattcggacccctgaggagatggagggcaggctttggaacc

SEQ ID NO: 82012 - DNA, 201 bp, Homo sapiens
gtcccagctactcatgaggctgaggtgggaggttgcttgaacctgggaagttgaggctgcagtgagccatgatcattgtgctactgcactccagcctgggygaaagagcatgactttatctcaaaaaaaaaaaaaaaaaagaaaaagaaaaaagtgttacctgttccagaatctgattgttgtttttttcaggctttattt

SEQ ID NO: 82013 - DNA, 201 bp, Homo sapiens
tctatacttaatttactaaagtttatatcagggatttatataaaattttattaaatgcttttatgaatctatttatatgacatcctttttctcctttaaayttttaatgtgttaaaattaaaactaaaactaaaaaaatgcttttaagatatatacaaaatatatgatatatatatagaaaaataagccaattattattat

SEQ ID NO: 82014 - DNA, 201 bp, Homo sapiens
atatgaaacatatacttaacatgtattttactttcaataataatagcattaagcctgggcaacatagggagacctcacctctacaaaaaaaaaaaaaaaaattcaaccgggcatggtgttgcatgcctgtagtcccagctactcatgaggctgaggtgggaggttgcttgaacctgggaagttgaggctgcagtgagccat

SEQ ID NO: 82015 - DNA, 201 bp, Homo sapiens
atggattagatatttctcctaatgtttgagatgaaaatgttaaggatagttggatatttttccattaacttactttgtttcaactatcatttataatcaakttataaatatattagtaggtttcagtttcaaatttattttggaacaagagaggttataaatatactttgtattctacctatactgtaaacattttaaaaa

SEQ ID NO: 82016 - DNA, 201 bp, Homo sapiens
ataaaaatgtgtacaaaaaaaagcacattcctagaaaaaggtattggcaaatagtaaaaatgggaggtcaaaagcaaaaaaaaaaaaaaaaaaaaacaaamcaaaaaaaagaaaaaaccaacaattcttcaattcagtgtgcaaacattatataaaaatagaaatactaactctacaggcagtatttcctgataaattatt

SEQ ID NO: 82017 - DNA, 201 bp, Homo sapiens
aagtttgaaatcaaggtgtcaccaaggccacacgccacctggaggccctaggagagaacgctagaacgcttccatgcttcttccagcttctcctggctatrggcattcctggctttgtggccacgtcactccagtctctgcctccgtcttcacattgcctccctccatctgtgtgtgttaatctccctctgtcttttttgt

SEQ ID NO: 82018 - DNA, 201 bp, Homo sapiens
agcattctgtgttattaaatattcttctaaatcattcattatgatggctgcaatgtatcttatgatgtatcataatttaagcatttctttatttttggtcrtttatattaagactttttgtataagctaaaactatcatgagacaaaaatatggtcataatcattatcttcccattacatgatggtgtgatgagttcagag

SEQ ID NO: 82019 - DNA, 201 bp, Homo sapiens
gtatagaaatgctcctgatttttgtatgttgattttatatcctgtaactttactgatttttttttgtcacttctgacagttttttggtggagtctttagcrttttctatatacaagatcatgtcatcagcaaagagagatagtttcatttcttcatttcctattaggatgccttttatttgtttttcttgcgtaactctgg

SEQ ID NO: 82020 - DNA, 201 bp, Homo sapiens
tttcttaatttcctatttagatagtttgttcttaatgtatagaaatgctcctgatttttgtatgttgattttatatcctgtaactttactgatttttttttgtcacttctgacagttttttggtggagtctttagcattttctatatacaagatcatgtcatcagcaaagagagatagtttcatttcttcatttcctatta

SEQ ID NO: 82021 - DNA, 201 bp, Homo sapiens
gcttaattagaatgaaaaggttggggaacgtggaaataaagttgaagaggcagattcttctgattagagagggtcaagctgagtgttcaggacttgatccracagggaacgctttgttggttcctgggcagaggacgacggcagagtagaaaaagtgtctgggaagaatagcctgagagtggtgtagagtcaggcagggat

SEQ ID NO: 82022 - DNA, 201 bp, Homo sapiens
gtcaatatgtctctccctgtccagagttagattgtcttagccttgtaagaaatgctgatatctgatagggtgcaggtcccctccttgcttttcgttttcaraagtatcttggctgttttaccatgtgaattttaaaatcaccttctcaagttccatgaacgacccatgtacgattttgactagaattgtacttaattttgg

SEQ ID NO: 82023 - DNA, 201 bp, Homo sapiens
atttaggattttttaaatgtatgctagtcacaggcacagaaatcttattgaccatctgctcatttccaaaacccatagaagccacaggagcatgcatttckgggtttgaggaacaaacaagaagttacttcagagctctttacctccagtgccaatctgttagatctccagttaaatctgggaaactgcccttgccacctc

SEQ ID NO: 82024 - DNA, 201 bp, Homo sapiens
tgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctca

SEQ ID NO: 82025 - DNA, 201 bp, Homo sapiens
ttgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctc

SEQ ID NO: 82026 - DNA, 201 bp, Homo sapiens
agaaactcgcttttgtacctaattttgaatttgtaattttgtattttttttttttttttttaagaaatgcccttctcttgcttcaagattatataaatttytggctctgtgaaacatgggtcagcttctgatgtccaaacatacaatcacctgggaatttcatttaaatattttaaattttatttctaagtgcatttttat

SEQ ID NO: 82027 - DNA, 201 bp, Homo sapiens
tttagtagagagggggtttcaccatgttggccaggatggtttcaatcttctgaccttgtgatccgcccgcctcggcttcccaaagtgctgggattacaggygtgagctaccgcacccagcccaaatgctttttttactaaaggcacataagcagagaataaacagtttgcttgtacctcataggggcagcagaataacttc

SEQ ID NO: 82028 - DNA, 201 bp, Homo sapiens
tcccaagtagctgggattataggcatgcaccaccatgctccagctaatttttgtatttttagtagagagggggtttcaccatgttggccaggatggtttcratcttctgaccttgtgatccgcccgcctcggcttcccaaagtgctgggattacaggcgtgagctaccgcacccagcccaaatgctttttttactaaaggc

SEQ ID NO: 82029 - DNA, 201 bp, Homo sapiens
taaggtcaagaacttgctagatccggccctttgaaagagtgtacttactagagtaattggggaaatggaaatatggagagattactggaacatgtgtcctsttcaggataaagtttctagtaactcaatacatgccttgatctttggtatgcatgtatctatctggcaaatggattttttttttttttgagacagagtctc

SEQ ID NO: 82030 - DNA, 201 bp, Homo sapiens
gcacaacaggttactcacatgtttgtggtgaagctggtgtaaacaaacctactgtgctgtcattcgtataaaagtatggcacatacaattatgcatagtaygtacttgacagtgataataaatgactatattactggtttatggatttcctatactatacttttaatcattattttagagtcttttacttattaaaaaaat

SEQ ID NO: 82031 - DNA, 201 bp, Homo sapiens
acttgaacccaggaagcggttgcagtgagctgagatcgcgccactatactccagcctgggtgacagcgagactccatctcaaaaaaaaaaaaaaaaaaaaatcatgtctgcttaggttgaaagataagtcaaatttccttatataatattggttaatttgcattgattattcatatttagttgcctaagatggtaacctga

SEQ ID NO: 82032 - DNA, 201 bp, Homo sapiens
tacttgaacccaggaagcggttgcagtgagctgagatcgcgccactatactccagcctgggtgacagcgagactccatctcaaaaaaaaaaaaaaaaaaaaatcatgtctgcttaggttgaaagataagtcaaatttccttatataatattggttaatttgcattgattattcatatttagttgcctaagatggtaacctg

SEQ ID NO: 82033 - DNA, 201 bp, Homo sapiens
tcactgaataatgcctgtaagaaacattttaaaaacctagttgtccctttgagacttttgtctatttccttttttatctccccttggacagtattttatcstggaacttaattctgcaaccccttttgtttcacaccttatttttctcaatacgttgcacattgttacttctgcccaagttaccttcaatgaaaatggttt

SEQ ID NO: 82034 - DNA, 201 bp, Homo sapiens
caggacgactgcgtcactgtacactgtccagaggtgactggctgagggaaagaagtggctgaaatctgctgtgttccatttgatgaatggtgcttgctggmacactgcttcttcttacacaggaggctccagtcactggccaagccttgcagtggggcgactttcatctggggccactgccctgttgctggcactcagaac

SEQ ID NO: 82035 - DNA, 201 bp, Homo sapiens
cagtcaaaagaaagaatggcatattactgctctttctgtagtgtgaataatatgtggttgcagtttttacatctgctttttattttcattttgtcttagcwagagaactaattgaagcaattttttcttaagatctgtggtttaactgtgcatacttttctttatccatctcctaaccctcaacaaatcagttcgttcttt

SEQ ID NO: 82036 - DNA, 201 bp, Homo sapiens
ggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaagt

SEQ ID NO: 82037 - DNA, 201 bp, Homo sapiens
agccattatgcgcaagcagtgtcacatccattcagctgacaggggcgagacactaatctcagtgggcatccagcaactgaaactgcagctggccttgggamgtttctgccaactctttaaatctttacaggtacagagttgctgcgggtgaccaaactttgtagccagtaagatcatgagaaagttaagcagtctgttact

SEQ ID NO: 82038 - DNA, 201 bp, Homo sapiens
tggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaag

SEQ ID NO: 82039 - DNA, 201 bp, Homo sapiens
cctaaagtcatcactgtttttggaccaataggcattgagaagttgtaagcttgatcttttaaaaaatggagacatccactgaccagcagctaattctgtgyagcactccacagcagacagggagaggagggaaagagttctacagggagagcatttttcagtctctagcctgctgtttacaaaggaagtgctggatgtcac

SEQ ID NO: 82040 - DNA, 201 bp, Homo sapiens
gagaatggcatgaacccgggaggcggagcttgcagtgagccgagatcgcgccactgcactccagcctgggcgacagagcgagactctgtctcagaaaaaaraaaaaaaattaaatcgggtcgggttaaggatgttcccttctctatacttaatttactaaagtttatatcagggatttatataaaattttattaaatgctt

SEQ ID NO: 82041 - DNA, 201 bp, Homo sapiens
tacatcatattattaacataacattgctattaatgttaactctgttcacctggctgaggaaatatttgtaagatttttccactgtaagttaccatatttcmccatcctttgccacactctactctttggaaagagattgctatttgcagcccctgcttaaggagtggtgctgggaaaacttgctaaccataggaagagaga

SEQ ID NO: 82042 - DNA, 201 bp, Homo sapiens
gtaggctgaggcaggagaatggcatgaacccgggaggcggagcttgcagtgagccgagatcgcgccactgcactccagcctgggcgacagagcgagactcygtctcagaaaaaaaaaaaaaaattaaatcgggtcgggttaaggatgttcccttctctatacttaatttactaaagtttatatcagggatttatataaaat

SEQ ID NO: 82043 - DNA, 201 bp, Homo sapiens
gcctgtagtcccagctacttggtaggctgaggcaggagaatggcatgaacccgggaggcggagcttgcagtgagccgagatcgcgccactgcactccagcytgggcgacagagcgagactctgtctcagaaaaaaaaaaaaaaattaaatcgggtcgggttaaggatgttcccttctctatacttaatttactaaagttta

SEQ ID NO: 82044 - DNA, 201 bp, Homo sapiens
tttggccggatgcagtggctcacgcctgtaatcctagcactttgggaggccgaggcgggcggatcacaaggtcaggagatcaagaccatcctggctaacayggtgaaaccctgtctctactaaaactacaaaaaattagctgggtgtggtggtgggtgcctgtagtcccagctacttggtaggctgaggcaggagaatggc

SEQ ID NO: 82045 - DNA, 201 bp, Homo sapiens
gtgagtttataattgatgtgcatttccctgatcactaatgaggtcaaatatttattcaaatacttatgtctaatatattccaccccccctttaaaaaaaaagcctattcatgtcttttgcccagttttttttgaattgtctgagtttttcttgttattatagaagttctttatatattcttgattctaatcttttggtggt

SEQ ID NO: 82046 - DNA, 201 bp, Homo sapiens
agaatagaacttcctaagaattcataaaaggcaaatttagcttgttttaattaacaaagagaaaaactgattcaaagacactaaacagcttagtaaactctgctgaagaatgaacctgtgtatatggatagctgaacacccagacaagatccattcttttcaattctgttttgagacctttgtagtagggactttccctgg

SEQ ID NO: 82047 - DNA, 201 bp, Homo sapiens
gagaatagaacttcctaagaattcataaaaggcaaatttagcttgttttaattaacaaagagaaaaactgattcaaagacactaaacagcttagtaaactctgctgaagaatgaacctgtgtatatggatagctgaacacccagacaagatccattcttttcaattctgttttgagacctttgtagtagggactttccctg

SEQ ID NO: 82048 - DNA, 201 bp, Homo sapiens
taagtattatgttagacgtaggtgttatcagaatgaagaaggtcccttctattcctaatttgctgagagtttttttttttaaatcatgaatgtatgttgamttttgtcaaatgcttttctgcattgattgatgatgactgtttttccttttaatctgataatctggtggattacatcggttgttttttgagtactcatcca

SEQ ID NO: 82049 - DNA, 201 bp, Homo sapiens
gcccacctcggcctcccaaagtactgggattacaggcgtgagccaccacacccagtctctttcatcttttgataatagttgttataacaggtgtgatgtascatctcgttttgattttaatttacattttcttaatgattaatgatgctaagtattttttcatgaacctgttggccatttttatgtcttcttttgggaaat

SEQ ID NO: 82050 - DNA, 201 bp, Homo sapiens
gtttcttgaattacacctaaaatccaaaggaacgtgtttctgaaagtggctgccaatttttttttttaagaggacaatcagcaccatctagtggacacaartatctcctcttctagaattcggacccctgaggagatggagggcaggctttggaacctaggttggaatcccggtgccagttagttccccaacgaccttggg

SEQ ID NO: 82051 - DNA, 201 bp, Homo sapiens
acctgcaatagctgacacagaagtatctggggaaattaaaaacaaatacacaacaaatgcaatttattaaagctggcccttaaggcacacacagcctctcrgcagtttacaaaatggaagcagcaggaggtaaataaacacgtgagagtgacacagagacaaaacaattcaaaatgagataaatagttttatgcaaatata

SEQ ID NO: 82052 - DNA, 201 bp, Homo sapiens
gtatctggggaaattaaaaacaaatacacaacaaatgcaatttattaaagctggcccttaaggcacacacagcctctcggcagtttacaaaatggaagcakcaggaggtaaataaacacgtgagagtgacacagagacaaaacaattcaaaatgagataaatagttttatgcaaatatagtcaatagggacttagtctgga

SEQ ID NO: 82053 - DNA, 201 bp, Homo sapiens
taatgaattctgccataaaagaggtgggaccattcacagcatgtcaactgaaggtaactctaacaaggactggtaactaagtctgtaacgtaattcaacamaaagcttccggattttttttaaaaagtcaccctgatttagatagaaagtgttattaaaaatagatgtttttattttggatttccctttagggcttagtgt

SEQ ID NO: 82054 - DNA, 201 bp, Homo sapiens
agaaaaattatgcatacaagcatagttaacacttggtcatgatcctgtctgaggttttccctattcacacataccccaaatgcttaccttcccccatcccwacacacacacacacacacacacacacacacacacacacacacacacacacacacagacaccccttccccctcctcctttcctctcttcttcaatctcctt

SEQ ID NO: 82055 - DNA, 201 bp, Homo sapiens
taatagaaaaacagaaaatacagataagcaaggggacaagaacatccagaaacccaccaatccagaacccactactcttacttccttgatgtgtcatcatytttcaggtccctttgtgtatattcctttaataagagaagttggactttttaaagcaggattattggcaacttgtatgtctttctctattttttttgatat

SEQ ID NO: 82056 - DNA, 201 bp, Homo sapiens
ataagctaaaactatcatgagacaaaaatatggtcataatcattatcttcccattacatgatggtgtgatgagttcagaggatttgatttatttgagtttkctttctttcttttcctagttagtctagctaagggtttgtcaattttgtttatcttttcaaaaagccaattcttagttttgttgattttttctattgttgc

SEQ ID NO: 82057 - DNA, 201 bp, Homo sapiens
gaaggaccagaattcctggagggtgttgtatgttttgttttctcagtgcaagacatctttgaggtttcctttgccatcaaaggctttctatgtgtgtttgytggggatggcggggggatttataggaaaggactttcactgagatataaaataattttccccaggaggatttttactttgctagtcttgttttggtatcta

SEQ ID NO: 82058 - DNA, 201 bp, Homo sapiens
acccagttttaaaagtttgtggctttctagaaatcatagtacagatggtccctgatttattatggtcaatttaatgatttttcaactttatgatggtgcaraagccatatgcattcagcagaaaccttaactcgaatacctataccaacattcttcttttcactttaggtacagctttcaagaaattacatgagatattca

SEQ ID NO: 82059 - DNA, 201 bp, Homo sapiens
tttccctattcacacataccccaaatgcttaccttcccccatcccaacacacacacacacacacacacacacacacacacacacacacacacacacacacagacaccccttccccctcctcctttcctctcttcttcaatctccttccctctcctctccttccttcctcctttttttgtctttttacaaaccaggatcata

SEQ ID NO: 82060 - DNA, 201 bp, Homo sapiens
ttttccctattcacacataccccaaatgcttaccttcccccatcccaacacacacacacacacacacacacacacacacacacacacacacacacacacacagacaccccttccccctcctcctttcctctcttcttcaatctccttccctctcctctccttccttcctcctttttttgtctttttacaaaccaggatcat

SEQ ID NO: 82061 - DNA, 201 bp, Homo sapiens
taaagaagaaaagaaaaattatgcatacaagcatagttaacacttggtcatgatcctgtctgaggttttccctattcacacataccccaaatgcttacctycccccatcccaacacacacacacacacacacacacacacacacacacacacacacacacacacacagacaccccttccccctcctcctttcctctcttct

SEQ ID NO: 82062 - DNA, 201 bp, Homo sapiens
gccaaccagtatctaatacatggaatgaggtttcaggccctgcctccactgaggcgcttcccactgggaagtactagagaatatttttaaagagtctctgyggacacagagcaagttttaggtttttttgtttttgtttttgtttggtatatctagaaacacactttgtgaatgtgaaaggttctcttgtacccaactaga

SEQ ID NO: 82063 - DNA, 201 bp, Homo sapiens
agttgagaatgtagtacagttataggtatttcgctgatgatcatgaattatcctgcaatgaataaatgacccagtaaccttttaaaagttattgactacadcaatataatttatgagaaatttaaaacataattagctggagttctttgagaggaaaatgtttttatttatttatttattattttttaaaattttacttta

SEQ ID NO: 82064 - DNA, 201 bp, Homo sapiens
cccagacttgtttcgggaaaggaagtgatagacatgtgataacagggccattccggcgacttgctcagaacaaagggcatctgatccaagtggacttgctstctctactgctagaaaacagctactgttggcaatcctcaaatggtaattgtcccacaaaatgaaaacataagagtccattttcaccagtcaccctgttag

SEQ ID NO: 82065 - DNA, 201 bp, Homo sapiens
gtgacttgtgggacacatgcagagagatgccatgtgggtgacttgtgggacatatgcagagagataccatgtgggtgacttgtgggacatatgcagagagmtgccatgtgggtgactgcacttcagggagtctttctgggggaaagtaactccttcactgccttccctctccccttggtcaaagtctgccccaaggggcat

SEQ ID NO: 82066 - DNA, 201 bp, Homo sapiens
aaagcctgtgttaactcaaagccaaatgacaggaaacctaaattaataggaattgtttttattcgaaggaggaaaatcataagaaaacaagctattattayattagtaagaaagcagagcacagagacttccgaagaatgttctgggggtgatatctgattgtttagctcttacctttataggattgtacagtgaatactt

SEQ ID NO: 82067 - DNA, 201 bp, Homo sapiens
tactgcatacagtactttctgatgctgaagacttaatagtgtcagccttgaagtgtaaaccttccgagggcgatgatagatgatagagaatcacatgccartctttacctcttgggtgccctctcccagcatctcatggcctctgtagcaccccctccccagcgccaggaatctacaagagtacacatgacagcttactca

SEQ ID NO: 82068 - DNA, 201 bp, Homo sapiens
ctaatattctgacagtgacacaaatatttgtttttcgtggaaaaatttggtagttctccctaaaatcttccctatgttttgaacttatagcttaaattcthtttttgtttgtaattactaatatattattagtaactagttaattttaatgcattccaaatctttcttggcctacttcatgtttttcttgctcaacataaa

SEQ ID NO: 82069 - DNA, 201 bp, Homo sapiens
aaataattgtttgagaagcaaagctaaccctcaaggctcagttgctttgaggtggtatgtgacagcacatttccagcctgtgaatgatgttttttttttttctttaaattagaaacctgaccgtgatggtgaaagaaatatggaagtaactccaggagaaaagatacttaggaacaccaaagagcaacgcgatctgcataa

SEQ ID NO: 82070 - DNA, 201 bp, Homo sapiens
accatcctggctaacatggtgaaatcccatctctactaaaaataccaaaaaattagccaggtgtggtggcaggcgcctgtagtcccagctactcgggaggmtgaggcaggagaatggcgtgaacccgggaggcagagcttgcagtgagccaagatcgcgccactgtactccagcctggaggacagagcgggactctgtttc

SEQ ID NO: 82071 - DNA, 201 bp, Homo sapiens
cagcctccttcgtatctgggactacaggtgcatatcaccacatttggctaatttttaaaatttttttgtaaaggtgaggttttgtcatgttgctcaggctkatattgaactcctgggctcaggccatacacctgccttggcctcctgaagtgctagaattataggcatgagccactgcacctggcctgcatgcatatgtct

SEQ ID NO: 82072 - DNA, 201 bp, Homo sapiens
tctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaacttc

SEQ ID NO: 82073 - DNA, 201 bp, Homo sapiens
ttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaactt

SEQ ID NO: 82074 - DNA, 201 bp, Homo sapiens
tttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaact

SEQ ID NO: 82075 - DNA, 201 bp, Homo sapiens
taccaccctcaccagtgaaatgggtttgcatccgatctcaggtcactcacatctagtagtattgagtcggggagtctggtggtggacccttagttacctayctgaaccctggctataaaggttgctggtgaaaagcattttctgttctgtcttgggaaggtaagtttcctaaaagctagaagttccccacacatagcaagg

SEQ ID NO: 82076 - DNA, 201 bp, Homo sapiens
tgtacagatgttttcatctggcattcagcgccctttgaaatacacacagctgccctttcagcctcatctaatcaatagttgccattctagttatgtgattytatattgaattcttcctgaacacttcttttaatcatttgttaaatgtattaattttctctgtctgtatgcaacagaaatggttgcatttagtgccttggt

SEQ ID NO: 82077 - DNA, 201 bp, Homo sapiens
ggtttttaagtcagaaaactaggaaggtttataaaaacctttggaaaatatctgttgcatgctaaactaaagtgagagcttaataaaaatatgcattaatkcaggactccactgccctcagactaagcacaagagatctctgttgaaccttgggaaaaataaacttactcccttggcatttatgagggtggcactaaaatt

SEQ ID NO: 82078 - DNA, 201 bp, Homo sapiens
atctaccagaaccgtccatggcctggggggtcaggagcccctgacctacaggacaaattaagctcccagatgggtctgcttttgcttacaaagggtttaaygattttttttagccaacatttaaaaattaggtaaattcctataaaaatccaaatttctagttctctcttgaaaaattcaaattagaaaatatgtcagcat

SEQ ID NO: 82079 - DNA, 201 bp, Homo sapiens
ccaggtctttatctcttcctatattttctggaggcaggaaagtttgtggaacctgtatctggtgagacctggtgggtaggtgactctagttggattctctstgctctttgggaaggctagctccctgctgaggcaacaggttctggaaactttgggggctatttggttattttgcactgaaaattaaatctaaaatgattt

SEQ ID NO: 82080 - DNA, 201 bp, Homo sapiens
tagatacagacaagtaggcagaactgtctgccccattctcctgccaacaacaaacaaaacataaaacataattccaaataagggaaatgcccattactcaractttccctttgaatctaataatgtcacccaagtcttgaggaatttgctaattgtttgtagatcctacaaggtcataatctagacctgttttaaaaaatc

SEQ ID NO: 82081 - DNA, 201 bp, Homo sapiens
gaaaaaaaaaaactgctggcaccacctttattgtatgtacattcttataagacctggagtttattgctcttcactcgagctctcccacaacacatgacaawaaactgttggaggaggaaaaaagctatcatctcgatgacataattttaatttttaacaagtcctttatttcagtacaacctgattatttgaaggtcagtc

SEQ ID NO: 82082 - DNA, 201 bp, Homo sapiens
ggattattttaaccaaatgtaaaagtatctagaagccagcccctttctggttactttgtggttactgcatacagtactttctgatgctgaagacttaatartgtcagccttgaagtgtaaaccttccgagggcgatgatagatgatagagaatcacatgccaatctttacctcttgggtgccctctcccagcatctcatgg

SEQ ID NO: 82083 - DNA, 201 bp, Homo sapiens
tgcgcttgaagagactcacctggtgccctgactgggattattttaaccaaatgtaaaagtatctagaagccagcccctttctggttactttgtggttactrcatacagtactttctgatgctgaagacttaatagtgtcagccttgaagtgtaaaccttccgagggcgatgatagatgatagagaatcacatgccaatctt

SEQ ID NO: 82084 - DNA, 201 bp, Homo sapiens
tgaggaagcacacctcaggatttgatgtgagggcaacaggaaatgagtaaacatttgaaatagagtttgcttcctgaggagggtgtgcgcaggcagagagsgctgaggggcagcctgaggagtaagagaaaaactgactaatggggcacgtgcccctgtgcgtggaacatgggatgaacctggcttagcttcagccctgcg

SEQ ID NO: 82085 - DNA, 201 bp, Homo sapiens
cagtttaaccctctggttagctttattatttgggtaaacctttgtgacaaacaagttttggggagttgactgtttcctgtgctggtcaagatctttgggargctgtgaagtgcttgaggtctgggaccatacttcatttgcttctgtctcaacaaattcctggtgctcaatgaactttccttggccttcttggacctctta

SEQ ID NO: 82086 - DNA, 201 bp, Homo sapiens
tgcccctgagtgttccctcggggaagaccagggacatgtaaatgttttttcctggaggcccaggaagcaaccaagatggcattcacttctgtgttctcttytagccatattcagtatctaacatcctgggcagtatattttatgcatactgtggcataagattgaacaatccatgtacacaagatgtcttttggtgaagct

SEQ ID NO: 82087 - DNA, 201 bp, Homo sapiens
gaaggccttaaggattaactggatattgtggaattacagactttttctggcatttggcagaaatatgtttttgaacagggaaccctgtttaaccacctccyggattacataaagtagacactattttgcttatttataaattgggccttcactagtttcgttttctgctaggtctgttttcttctctgttaattcatggta

SEQ ID NO: 82088 - DNA, 201 bp, Homo sapiens
tcttttattcacctcaaaataccaaattatagcagccatatgtccccattttggctttaaatcatctatgttgattgcatttctcagaagcctctatgaaraactttaatcttgtttgaaatgaatgttatataagttggcacttgttacagtttagaatctggtcatatatctaatctatttaatcaagtatcatgaagt

SEQ ID NO: 82089 - DNA, 201 bp, Homo sapiens
tatgatttattgttgttccttgtacataagaaacagtaatatacaacttacactgctttagaatgtaaaatggataaaaatgtgtacaaaaaaaagcacaytcctagaaaaaggtattggcaaatagtaaaaatgggaggtcaaaagcaaaaaaaaaaaaaaaaaaaaacaaaacaaaaaaaagaaaaaaccaacaattct

SEQ ID NO: 82090 - DNA, 201 bp, Homo sapiens
aatggataaaaatgtgtacaaaaaaaagcacattcctagaaaaaggtattggcaaatagtaaaaatgggaggtcaaaagcaaaaaaaaaaaaaaaaaaaamcaaaacaaaaaaaagaaaaaaccaacaattcttcaattcagtgtgcaaacattatataaaaatagaaatactaactctacaggcagtatttcctgataaa

SEQ ID NO: 82091 - DNA, 201 bp, Homo sapiens
ttttgaaaactgcattttcttgaggcaggtcgcacgttctaggagtccacactgatgcaagcacagaaaagaaggaagccaaggagaagtgatcctggggrttttctcaagcccatagttccagaaggtgcaataccagcattggtttatgatcagtctttcaatcaacaatttgatgattagggatctgttaaataaaca

SEQ ID NO: 82092 - DNA, 201 bp, Homo sapiens
atgagtaagggtggggatcagggaggaagtccagaagccagtctttgtctccctttcctgcttctatttaagtgcctatttacatgggttaatcagctaaygccagtcagcatcatgaaatccagcaatagtctttcaatcccctgaaaatgacttagtaccgaacatgtaacagttcctccatattttcttcatacaatc

SEQ ID NO: 82093 - DNA, 201 bp, Homo sapiens
tggccagagcaagaggaagagagagagaagagggaggtgctacacacttgtaaacaaccagacctcatggtaactcattcactcacaatcatgagagcagyactgagggatggtgctaacccattcatgagaactccacccccatgacccaatcacctcccaccaggcgccacctccaacactgggggttacaattcgaca

SEQ ID NO: 82094 - DNA, 201 bp, Homo sapiens
cagggacaggggcagggaaccttcctggggtgcccgagggtgcaggctgcagagacgccctgcacgtgggagggcagcagcagctgcagccaggagctccsgcctggccaactcggaagaggcagggctcccgcttgtccccggctcctgcctgcttcccaactgggagttccagatctgcagccaccagtgccgtggctc

SEQ ID NO: 82095 - DNA, 201 bp, Homo sapiens
aaaagctgaaggtttataatctataaataatatatttggtaccttgtggctatttcaaatagtaatgttaaaatttgcatttgtgacaagtggaaaattaygtagctagggagatgcctgtgatgacgttgtttgtgataatgttgttttccccccttaatcaattaatactttttttgcattgaataatcattaaaatgc

SEQ ID NO: 82096 - DNA, 201 bp, Homo sapiens
ctgacctcaggtgatctgcccacctcagcctcccagagtgctgggattacaggcgtgaggcaccatgcccaaccgtcatgcataattttatggatgtaatmttctcttgaatctctctaggacggggactggtaccagttgggcccatggcctgttaggaactgggctgcacagccggaggggatgagcggtgggctagcg

SEQ ID NO: 82097 - DNA, 201 bp, Homo sapiens
ctgtaatcctagcactttgggaggccgaggcgggcggatcacaaggtcaggagatcaagaccatcctggctaacatggtgaaaccctgtctctactaaaamtacaaaaaattagctgggtgtggtggtgggtgcctgtagtcccagctacttggtaggctgaggcaggagaatggcatgaacccgggaggcggagcttgca

SEQ ID NO: 82098 - DNA, 201 bp, Homo sapiens
atgggggcccttgacttagggataatttctcttttatatgtttttgatatggcaggctaatgtatcattttgttcttttattccacaaacgcagcaaattytaagcctaggcctgagcaactcagtctttctcaatcacatacaaactgtgaatgttgctatgacttactgtaatttatttttgtatatgctatattgatt

SEQ ID NO: 82099 - DNA, 201 bp, Homo sapiens
atgtcaactgaaggtaactctaacaaggactggtaactaagtctgtaacgtaattcaacacaaagcttccggattttttttaaaaagtcaccctgatttakatagaaagtgttattaaaaatagatgtttttattttggatttccctttagggcttagtgtttgtccggaacaaggtgaaaccccgtctttactaaaaata

SEQ ID NO: 82100 - DNA, 201 bp, Homo sapiens
ctctgtatggtaactataaggtagtaagttggtatgcatatagatttaagatgataaatgtggttgagtcaatgtggttaagtcagaatagtttgaggaastctaggaatgtggctcagagatgaaggaggtgttggtctttgtgaaaagggcagataagaagtcttcttttccttatgggctcactgattgtgatgttct

SEQ ID NO: 82101 - DNA, 201 bp, Homo sapiens
tgaaggcatgatattttaaaaattcctttgaagatttatctttgttggtcaagaaaacagttttctgaacaagttgaaacatagactttctgacttatctstgtatggtaactataaggtagtaagttggtatgcatatagatttaagatgataaatgtggttgagtcaatgtggttaagtcagaatagtttgaggaactc

SEQ ID NO: 82102 - DNA, 201 bp, Homo sapiens
atgtcataagaaaatgctcattatgtactggtgaaaaacacattagtccaattttgttgaaaaagacagagcaaaaatgggaaagatgtaccaatagcgtwtagctcagggtggtgggatgttgggtgatttttatttcttttcaaataccttttagtacattctagagatctttctataataaatgaattctttagttat

SEQ ID NO: 82103 - DNA, 201 bp, Homo sapiens
tatctacgtggttccactgtgagtgagtgtgggtgtgtctgagggcaccctgccatggcatcctgtccagggtgtgttcccacctgggactctgagctgcmcagatagactctggccacttgagactctgaattagaataagctgataaataattaccttgcttatttttattaatttttctgaaatgtacttatagccca

SEQ ID NO: 82104 - DNA, 201 bp, Homo sapiens
ttttatttttaattttttaaatttttattttttagagatgtgatctcattttgttgcccaggctgtagtgcagtggcatgatcactgctcgctgccacctygaattcctgggctcaagggatcctcccacctcagcctcctgagtaactgagattacaggtacatgccaccatgcccggctaatgtttaaatttctgtaga

SEQ ID NO: 82105 - DNA, 201 bp, Homo sapiens
tttctggttgtttttttccttttatctctgagtcaagggggtgctttccatctagatctaagtctgcccctgcgctgtttcagtaggcaaagcttacatgrccactgattgcttttctctttccctttctatcatttgtgttggtggcaattttttccagattctggaaatagagaacattaggtcgttgaatgaaattgt

SEQ ID NO: 82106 - DNA, 201 bp, Homo sapiens
gaagaggcagattcttctgattagagagggtcaagctgagtgttcaggacttgatccgacagggaacgctttgttggttcctgggcagaggacgacggcasagtagaaaaagtgtctgggaagaatagcctgagagtggtgtagagtcaggcagggatggaaaagaccaaagtacagtgaagagcaaggagccttagaaaa

SEQ ID NO: 82107 - DNA, 201 bp, Homo sapiens
ggacacagcccccacctagccctctctacttcatgggcttggtcctttggagacattgaatttccattccatgttgtaagtctcctctgcttgtagtgcartccaaccactgggagcttgttagagatgcagggcccctaagggcccacccacaacctaaggcatgagaattttcattttaataagatccctggtgatact

SEQ ID NO: 82108 - DNA, 201 bp, Homo sapiens
gagaattgttttgcctgtaatatgattaatacccccagggaaaattcacctaatatatgattaacttttataagtactccgtggacacttgaaaagaaggmctgtttctctctgtggagaacaaactttgaaatgtgcaaaatgtccttattacttgtctatttgatttgcattcatcttagagagttctgttaaggtctt

SEQ ID NO: 82109 - DNA, 201 bp, Homo sapiens
aaactggaatggttggtcactctaaattgaaactgtgaacataaaaccaaagagcagattagttactcaaaggaccaaattaagggagtccaagtaagtascagaatcccaagctagaacctagattagcagagggagggtggcctaccacccaccagtgggaagtggcctagtggttaggaacatgggttctgggtaggg

SEQ ID NO: 82110 - DNA, 201 bp, Homo sapiens
ctaactaggtttagtttgttatttttgcagttccttgaagcataatgtcaggctacttatttgagatctttcttcttttataatgtaggcatttattgctrtaaacttccctcttagaactgtttttgatattttgaattggttgaaattttctttatagcttattagagaggttctcaattgtaggagacatttggatgt

SEQ ID NO: 82111 - DNA, 201 bp, Homo sapiens
cagttcgttctttccacgtattgtaaatcccaccataaaactgagtgatgttctataatttagttaccatacttcttattcgtagaagtatcagattccakttctctccagaaatatctaagatataggagttatgtaagcattcagtttcttaaatccttagcaaccggattcaatagtaaattctattccatttggctg

SEQ ID NO: 82112 - DNA, 201 bp, Homo sapiens
tattatacattcctgatctcttactgctttcaggattctttgtctttgttttattttaattttaatttaattttattttaaggcagagtcttgctctgtcrcccagactagactgcagtggcatgatcctggctcactgcagcctctgcctcctgggttcaagcgattctcctgcctcagcctcctgagtagctgagactg

SEQ ID NO: 82113 - DNA, 201 bp, Homo sapiens
ttttatgactaaattctcaaaaacaatagcaacaaaaacaaaaattgacaatgggaacctcattaaactaaatatactaatcgttatttagaaaatgatgrtgactttcttttcttctccagaattttgtacaagtcctatattttaaaaatgaatattgagtctcataatattgtggtcatggttttgatattcttaaaa

SEQ ID NO: 82114 - DNA, 201 bp, Homo sapiens
tttctctcagttggtggtttgttcattttcacagtggtggttttgattaagcaacatttaaaaatgttgttaagtgcaacttataatttttttctttctgkgccttctctttgcttgccccaagatttagaaaaaatcatagttgtagattattaaaataatttcaatttaaaaatgaaatccggggtgttttgcagatta

SEQ ID NO: 82115 - DNA, 201 bp, Homo sapiens
aaatggttgccggggctacagtcatttgaaagctttattggagttggagaatcggcttccaagctcactcacatggttgtttgcagacctcagtttcttgytgcctttgggttggagaccttaatttcttactacgcaaacccctccataggatgcgtgtatgtcctcacaacatggtagctgacttctagagcacttagt

SEQ ID NO: 82116 - DNA, 201 bp, Homo sapiens
ttatcatgaaatggtgttgaattttgtcaaatgctttttcttcatctattgagattatcatatggtttttatccttcattttattaatgtggtatatcccwcttattaatttgcatatgctgaaccatccttgcataccagggataaagcccatttgatcatgtgaatgattcttttaattgcttttgaattcggtttgct

SEQ ID NO: 82117 - DNA, 201 bp, Homo sapiens
taatcaatcatatatagccatacatttctaaataagatatttttataagtattattaggaaaacaggaaaattttgcctttttttcctgtataattttttrttgccagcacagtttcaggcacttgtaaattgtccagtaggtggcagcatctagttacaataagtactttaaaaagccttaaagcatttaaaaaaatttt

SEQ ID NO: 82118 - DNA, 201 bp, Homo sapiens
aaatctcatgggcattatatttcagggagacctctatttccattttcagagagatttctctgattctgttgatgggatgaagtagaagaagtaggaatggkctgggtgcggtggctcacgcctgtaatcctagcactttgggaggccgaggcgggcagattgcctgagctcaggagttcgtgactagcctgggtaacaagg

SEQ ID NO: 82119 - DNA, 201 bp, Homo sapiens
tctttagtagagacgagatttcaccatgtgggccaggctgggaacatgggacatcttttaattgatttgctttttcttcactttctttcatcagtgttctrtagttgtcaatatatagttctttcacctccttggttaattttttttattagagacaattgttaatgggattgttttcttaatttcctatttagatagttt

SEQ ID NO: 82120 - DNA, 201 bp, Homo sapiens
taaggtggtacgaagctactttcatctgttctacaatgaaatgaatttcccattactcattagatctcagctactgttttaattagaaatgtataaaaatwtaaaaattattttaatcaatcatatatagccatacatttctaaataagatatttttataagtattattaggaaaacaggaaaattttgcctttttttcct

SEQ ID NO: 82121 - DNA, 201 bp, Homo sapiens
taacaatttgggaggccgaggtgggtggatcacttgaggtcagaagttcaagaccagcctgaccaacatggtaaaaccctgtctccactaaaaatataaawatatatatatatatatatattagccaggtgtggtggtgggtgcctataattccagctaccggggaggctgagacacgagactcgcttgaacccaggaagc

SEQ ID NO: 82122 - DNA, 201 bp, Homo sapiens
tctgccatctgaaggagttgcattacaaaggtaggtcagttctccttctgccctactcccagatgtgtaactaaacttagatcccagaatgcctcaagacrccaatgacaaagtcaaaggtaggaggtgatagcttatggtgctaaaaagttgcaagactttcccaattgatactggaaaatattctgggggaatatgtat

SEQ ID NO: 82123 - DNA, 201 bp, Homo sapiens
ttttctgccatctgaaggagttgcattacaaaggtaggtcagttctccttctgccctactcccagatgtgtaactaaacttagatcccagaatgcctcaaracaccaatgacaaagtcaaaggtaggaggtgatagcttatggtgctaaaaagttgcaagactttcccaattgatactggaaaatattctgggggaatatg

SEQ ID NO: 82124 - DNA, 201 bp, Homo sapiens
ccctattgcctaaagggttggggaccactgtctgagagacttcatttcattgctttaaaatcaagagagtagtgcaagatgacctctgttcttttgccagmgattcttggcacacttatttttgataagaagtgatgttatttgtaatatatagtatctaaaactagtttgtgtttcctaaatatttgttattaattggat

SEQ ID NO: 82125 - DNA, 201 bp, Homo sapiens
gcattgtcattattgcatcaaaatgtttagcactctaagccctgttgctgagcattgaggataagaatgtggctgacaaaggatgataaatcctctcattytgattcttatttcgacatgctcttgtcatttaacctgatataagcatatatgaaccccagtcagaagactggagtgttccttctgcttagagaatggggt

SEQ ID NO: 82126 - DNA, 201 bp, Homo sapiens
aaagccttgtatagacactggggtgggcaatctttcctctgtgctcaaggccataggacatcccttcatatgtttgtagtaattttctctggagctcaaartggaaagcaatgggctgattattattttgacagtcataatttgtgaccagactttaaaaaaacattgtggtcaatgatgttgcacaattactttttgtct

SEQ ID NO: 82127 - DNA, 201 bp, Homo sapiens
caaaggaaagcacctttaaggtaaggaaccttgtcataagagattggttatttttgataaagtcctccttgaacagttgactgacttctgggaaagtttcmtaggcaataatgtgaattaaaaatgtagtaattaaaaatacatttttatgaggttcccaggaagtccactgggatggaaagaaagaaacatccaaaatgc

SEQ ID NO: 82128 - DNA, 201 bp, Homo sapiens
gcaatgggctgattattattttgacagtcataatttgtgaccagactttaaaaaaacattgtggtcaatgatgttgcacaattactttttgtctgtcacawagacaaaacaaatccagatttaattcagtgcaaacaaataaataaaatgctctgctaagagtatagagtcaagcttttgatctagtgggagaggctgaga

SEQ ID NO: 82129 - DNA, 201 bp, Homo sapiens
agggaggctgaggcaggaggattgcttgaggccaggagtttgagaccagcctggacaacataaagagaccccatctgtacaaaaaaaacctaaaaaattasccaggcatggtagtacgtgcttgttgccctagctacttgggaggctgaggtgggaggatcccttgagcccaggagttcaatgctatgcagtagctatgat

SEQ ID NO: 82130 - DNA, 201 bp, Homo sapiens
aatgggctgattattattttgacagtcataatttgtgaccagactttaaaaaaacattgtggtcaatgatgttgcacaattactttttgtctgtcacataracaaaacaaatccagatttaattcagtgcaaacaaataaataaaatgctctgctaagagtatagagtcaagcttttgatctagtgggagaggctgagact

SEQ ID NO: 82131 - DNA, 201 bp, Homo sapiens
aaagtccatcaatccacccttgccagttagagcagccctgtgaccttctctgatgaggctattcgtgtcttgatggaattttctgccatctgaaggagttrcattacaaaggtaggtcagttctccttctgccctactcccagatgtgtaactaaacttagatcccagaatgcctcaagacaccaatgacaaagtcaaagg

SEQ ID NO: 82132 - DNA, 201 bp, Homo sapiens
ttggccttacttagcacaatatgccacttctaatgatctaatctggggtggctgagacttactgtttgagcattcatgctcattcattgctggattatcasctttcatcagatttaaatggagagaatattatctgtggctaagaggctaagaactttggctctgcagtcagacagatttgggtggaacctgactggcatt

SEQ ID NO: 82133 - DNA, 201 bp, Homo sapiens
ataaatgacatgagagaaatagaaataaagtgctgtatttgatcaaaatagagaacagttatagcagagcgatttggaaaggctttgtggaaaatgtgaartcagaattgagccttgaggaatgagtagggtttcatttggtatagatgggggtgggtgttacagaaagaagacactttgtggaaaagggccagcttttgg

SEQ ID NO: 82134 - DNA, 201 bp, Homo sapiens
gggaactagaacaggggatatggtaggatttggtgaattcagggcaccccgaatccctaaagtccatcaatccacccttgccagttagagcagccctgtgrccttctctgatgaggctattcgtgtcttgatggaattttctgccatctgaaggagttgcattacaaaggtaggtcagttctccttctgccctactcccag

SEQ ID NO: 82135 - DNA, 201 bp, Homo sapiens
gctttgaagtgaaaattacagttttggaaaactgcatatgtcactgtgaggttgatagctttccagtacttagacttttcttttttttttttttttgagayggagtctcgctctgtcgcccaggctggagtgcagtggcgcgatctcggctcactgcaagctctgcctcccgggttcacgccattctcctgcctcagcctc

SEQ ID NO: 82136 - DNA, 201 bp, Homo sapiens
gaatttggtattggatcagatgggtgacaggagtgtggaattttgcagatgactcaggaagaaactcgttttcacattggaggtctgctttcatccactcyggatgacaggaaatagaaggaagtaaaattataaaagtagagtgaggccatgttgaatagcaggctgtgactggtggataaagttttctaagcagctatt

SEQ ID NO: 82137 - DNA, 201 bp, Homo sapiens
aagagtgggactctgggaactagaacaggggatatggtaggatttggtgaattcagggcaccccgaatccctaaagtccatcaatccacccttgccagttrgagcagccctgtgaccttctctgatgaggctattcgtgtcttgatggaattttctgccatctgaaggagttgcattacaaaggtaggtcagttctccttc

SEQ ID NO: 82138 - DNA, 201 bp, Homo sapiens
caaggagcaggcccgtctgccttatcccagagcccggcagatagcagttcccttcaggactgatgtagactcttctccattattgctagggattgctggaraatggtgcaaatgttattacatggaattgtgtagttaaattacatttaattagagtgttatatttctagaatactttaatgctagtgtatgcatttatgt

SEQ ID NO: 82139 - DNA, 201 bp, Homo sapiens
gttcttccttactgataaaattctagttaaaaatgctgtctcagactcccttgtaactagggtgaccacataagttagttctggccagtcagataaaagcrgaagtctcctgataaaaagaaaaaccgctgacatgtgccttttgcccttcatcttttcccttcttagttggagcatagatacactgcctgaacattcagg

SEQ ID NO: 82140 - DNA, 201 bp, Homo sapiens
gctgcatgtaacggtggcagacagcttaaagaaagggaatataagctcagattcctaaatattcttacctaaggatggattgaaaaatagggactttctaygagtacactaaaagaatctcttttgtactatatataaatattacaaatttattttgtaactctttcagggttaaaaagtcaaaagccaaatgcagtaatg

SEQ ID NO: 82141 - DNA, 201 bp, Homo sapiens
accactcccggctaatttttttgtatttttagtagagacggggtttcaccgtgttagccagggtgttcttgatcctcctgacctcgtgatctgcccgcctyggcctcccaaagtgctgggattacaggcgtgagccaccgcgcctggccaaaattgattgttaattgtgaaaaagcaagttgcaaagcaccatgccatttg

SEQ ID NO: 82142 - DNA, 201 bp, Homo sapiens
agatacactgcctgaacattcaggaggcatcttgagaccacaagggcaggtcggaaagacagaggaggctagggcagttgtcccatcataaagctattgcwtcacctcttatctgtttacctctgaccaatttcttaagttggaaaataaaccaaccttggttatgccaggcaggtcattgggtttcttttatgaaagcaa

SEQ ID NO: 82143 - DNA, 201 bp, Homo sapiens
aacgactttcactggaaagtcagaacatcaagtcggttttacatcatttttatgcatcatattttattatatttgtcatagtgcttatttgctttcaaatmccataaaccctgttaattatagtcaataaacagtttcgaggatttttttgcttacttatacagctggttactatgcgatgagaggcaaatgacaggcatc

SEQ ID NO: 82144 - DNA, 201 bp, Homo sapiens
ctgaagttagaatatctcagaaatctttctttgggcagtatttgctaatgtaattattatttatcccagttcattccatacattaagtattctggaagggyatttaactcttcacattcttattggccaaccagtatctaatacatggaatgaggtttcaggccctgcctccactgaggcgcttcccactgggaagtacta

SEQ ID NO: 82145 - DNA, 201 bp, Homo sapiens
gcatctatgggatattatgctgttgtttgaaagcatgacgtatatctataaatggtgatatagaaaaatagataaaataaatttttttttctttttttgasacggagtctcgctctgttgcccaggccggagtggtgcaatctcggctcactgcaagctccgcctcccgggttcaggccattctcctgccttagcctcccg

SEQ ID NO: 82146 - DNA, 201 bp, Homo sapiens
taaatcatgtaaatggtaaagtggcaaccagagacttgaagctatgactcatagttcatgcaatgaacctctgaaacatttcatcaggtaaaccaggaaamcgactttcactggaaagtcagaacatcaagtcggttttacatcatttttatgcatcatattttattatatttgtcatagtgcttatttgctttcaaatac

SEQ ID NO: 82147 - DNA, 201 bp, Homo sapiens
gaattgcttttaatagcaaatattctatataccacctaagtgaactgatgaaaaaagtgctgcatctatgggatattatgctgttgtttgaaagcatgacrtatatctataaatggtgatatagaaaaatagataaaataaatttttttttctttttttgagacggagtctcgctctgttgcccaggccggagtggtgcaa

SEQ ID NO: 82148 - DNA, 201 bp, Homo sapiens
ctgtgagagaataacttctgttgtttgaagccaccaagtttgtggtaatttgttagggccgctatagaaaatgggtatactttcaaatacattcctagaaragaaatacttagtccagggttggactttcacaagatttttattcacattgacttattgaaatcaatttagactcttacccacattgtatctgaatattat

SEQ ID NO: 82149 - DNA, 201 bp, Homo sapiens
cctggcctcaagcaatcctcctgcctcagcttctcagagtgctgggattacggcccaaaccagtagtgttaggagatctcttgggtgtcgatttttctggkgggaaacctctgtggccccagcacctttgcccgagttcttgtcctgcatccaggaaaaatgaggtacacagacaagtgaagggtgaagaagcagagtttt

SEQ ID NO: 82150 - DNA, 201 bp, Homo sapiens
ttttagaaattttatagttttggccaggcacggtggctcacccctgtaatcccagcactttgacaggctgaggcaggcagatcacttgaggtcaggggttygagaccagcctggccaacatagtgaaacctgtctttactacaaatacaataacaataacaacgacaaaaagaaaattttatagtgtgaagttttacttta

SEQ ID NO: 82151 - DNA, 201 bp, Homo sapiens
tctccagggtagctgggactacaggcacacatcaccaaacgcagccttttttttttttttttttttttttttttgtagagatgaggtctcgctatgttacscaggcctgtctcgaactcctggcctcaagcaatcctcctgcctcagcttctcagagtgctgggattacggcccaaaccagtagtgttaggagatctcttg

SEQ ID NO: 82152 - DNA, 201 bp, Homo sapiens
tggtgatttcatttccattagactttttttttttttttaagagacagtgtgtcacagtgtcactctgtatcccatgctggaatgcagtggtgcaatcatakctcactgtaaagctcaaactcctgggctcaagtactcctcccatctcagtctccagggtagctgggactacaggcacacatcaccaaacgcagccttttt

SEQ ID NO: 82153 - DNA, 201 bp, Homo sapiens
taatgctgcaatgaacaaggaaatgtggatacctttatgaagttaagtggtgatttcatttccattagactttttttttttttttaagagacagtgtgtcrcagtgtcactctgtatcccatgctggaatgcagtggtgcaatcatagctcactgtaaagctcaaactcctgggctcaagtactcctcccatctcagtctc

SEQ ID NO: 82154 - DNA, 201 bp, Homo sapiens
tccaaaaaatgtcacttactttagtaaacttctgttgtcttttgcatattaatgcaagtccacaagattgtgttagtgagaactcatgggtaacagagtgmtttccacataattgttttgattcttacaaaaactgtatggggtaggttattctgctgactttatagatgaagaaattgaggctcatattgatcaagcaat

SEQ ID NO: 82155 - DNA, 201 bp, Homo sapiens
ttatcatttagagatgatgtcagtatgaacctgaatggaagcactgaagttgtgacgaatgtttggattctgaatatattttgaatgttgagctgataggwcaaatagattgtagagtgagagaggaagaagaattgaggatgactccaaggtttttggtctaggcatggcaggctgaaattaccatttgctgagatggat

SEQ ID NO: 82156 - DNA, 201 bp, Homo sapiens
aatctcagctactcaggaggctgaggcaggagaatcgcttgaacccgggaggcagaggttgccgggagccaggattgcgccactgcactccagcctggcarcagagcgagactccgtctcaaaaaaaaaaaaaaaaaaaaaaaagacatggcctgtttttcaaagtggttgtacctttgtatagtcctgcaaacaatgtaa

SEQ ID NO: 82157 - DNA, 201 bp, Homo sapiens
aaaataaaataaaaatagtgtattagtctgtttcatgctgctgatgaaggcatacctgagactgggcaatttacaaaagaaagaggtttaattggacttayagttccacatggctggggaagcctcacagtcatggcagaaggcaaggaggagcaagtctcatcttacgtggatggcagcaagcaaagagaaagggcttgt

SEQ ID NO: 82158 - DNA, 201 bp, Homo sapiens
gtgaagagacacaaagtttacgtggaacccgaattttattttcacttgctttatatgcatcttatgttgcattttaaaaacaacagttaaaaaaatgaaamcagcagtaatcataggtccgctttttcttagttcagccccttccccccccgagaaattgggaaggtattgttttcttagtggacactattagtcaccaaa

SEQ ID NO: 82159 - DNA, 201 bp, Homo sapiens
tgtgtaggcctaggctaatgtgtgtgtttctatttagtttttaacagtaccatttaaaagtaaaaaaaataaaataaaaatagtgtattagtctgtttcaygctgctgatgaaggcatacctgagactgggcaatttacaaaagaaagaggtttaattggacttatagttccacatggctggggaagcctcacagtcatgg

SEQ ID NO: 82160 - DNA, 201 bp, Homo sapiens
ggaagttgaggctgcagtgagccatgatcattgtgctactgcactccagcctgggtgaaagagcatgactttatctcaaaaaaaaaaaaaaaaaagaaaargaaaaaagtgttacctgttccagaatctgattgttgtttttttcaggctttatttacttccctgttcatgacccttgctggcatggatggcattgtggcc

SEQ ID NO: 82161 - DNA, 201 bp, Homo sapiens
tactctttgtcacatatgttacagattttactacctctaaagtgttaattttatttactgttctacaatattgaaaagttttgcaaggtgctatttttctytcttattttcatatggagtcatttgtgagaaatatatgctgggtattgcagcctgctttttgtttcttgaagtgatccatcaaaagcatttatatacttt

SEQ ID NO: 82162 - DNA, 201 bp, Homo sapiens
ttggtcattgaagtactgcatatacgacggtggtcccataagattataatggagatgaaaagtttctatcacctagtgactaggtagctgttgtaacatcrcagcacaacaggttactcacatgtttgtggtgaagctggtgtaaacaaacctactgtgctgtcattcgtataaaagtatggcacatacaattatgcatag

SEQ ID NO: 82163 - DNA, 201 bp, Homo sapiens
gcagataaatgggctaagaaagagattatgtgattgattatgacctttctatattgtacctgacttacattaagtatgtttttaatacttaaaactagttkactaaaaatgcctttaaaaatgagtctttatatatatatatcttttttttattttttattttatttgtttgtttattttttttgagacggagtctcactg

SEQ ID NO: 82164 - DNA, 201 bp, Homo sapiens
agccagtagtcctgcaactgctgaaaaacgaatatacgtgttatatctgagagaatatatcctcttgcttcctcttaaaacttctgaaggggttgtctttsctctgactgggcagactgaattggatttattgtctctcaaagagctctagcagtttttctataaatgatccatttaaaatttctgctgagttgcaatatt

SEQ ID NO: 82165 - DNA, 201 bp, Homo sapiens
agggtacagtgtggtcttttgatatgtatatatattgtagaaagattaaatcaagctgataaatatatatccatcacttcaccttcttatcattttttttkgtgatgagaatatttaaaatctattcttctgtgttccttcagtttttgtttcatcttcatgaaaaccttagaggcaggtggcatagctatcactacctct

SEQ ID NO: 82166 - DNA, 201 bp, Homo sapiens
atattgtagaaagattaaatcaagctgataaatatatatccatcacttcaccttcttatcatttttttttgtgatgagaatatttaaaatctattcttctrtgttccttcagtttttgtttcatcttcatgaaaaccttagaggcaggtggcatagctatcactacctctattgttacagataaggacaccagacataggg

SEQ ID NO: 82167 - DNA, 201 bp, Homo sapiens
tcctgactgatgtggttgtccttgtgaactagctccagccagccagtagtcctgcaactgctgaaaaacgaatatacgtgttatatctgagagaatatatsctcttgcttcctcttaaaacttctgaaggggttgtctttcctctgactgggcagactgaattggatttattgtctctcaaagagctctagcagtttttct

SEQ ID NO: 82168 - DNA, 201 bp, Homo sapiens
ttaggccagttgcggtggctcacgcctgtaatcccagcactttgggaggctgaggtgggcggatcaccggagatcaggagtttgagaccagcctggccaasctggtgaaaacccgtctctgctaaaaatacaaaaattagcttggcatggtggcaggcacctgtaatcccagctactcaggaggctgaggcagaagaatta

SEQ ID NO: 82169 - DNA, 201 bp, Homo sapiens
tccgccagcctcagcctcccaaagtgctgggattacaggtgtgagccaccgcgtccagcccagtgttttttactgtactcacagagggtacatccttcacyactatcaaatactggaatactttttttaccctcaaaagaaaccttatatccattagcagtcactccccatttcatggcataaccactgatttttttctgc

SEQ ID NO: 82170 - DNA, 201 bp, Homo sapiens
acggggtttcaccatgttagccaggatggtctcgatctcctgacctcttgatccgccagcctcagcctcccaaagtgctgggattacaggtgtgagccacsgcgtccagcccagtgttttttactgtactcacagagggtacatccttcactactatcaaatactggaatactttttttaccctcaaaagaaaccttatat

SEQ ID NO: 82171 - DNA, 201 bp, Homo sapiens
tcctgggttcacgccattctcctgcctcagcctcctgagtagctgggactacaggcgcccgccaccacgcctggctaatttttcgtatttttagtagagayggggtttcaccatgttagccaggatggtctcgatctcctgacctcttgatccgccagcctcagcctcccaaagtgctgggattacaggtgtgagccaccg

SEQ ID NO: 82172 - DNA, 201 bp, Homo sapiens
accttacagtctagtgttggatagtaagataatcatccctatccagctgaggcagaaggaagtcgatttgatttctcagtactgttgagtgtggaaggctrgagaagacctcactgctgattaatgtatccacctcattatttttcattgagcaacattgtgcaaattaattgagagttgcagggcctgtgactacatatc

SEQ ID NO: 82173 - DNA, 201 bp, Homo sapiens
gggaagtgagcggagggcatgcaactcagccccttctgccttgtacccaggtttccagggctgcagtgccaggcaggcgtagcgtgggctgacgccatggrgagggctccactccccttctcccctttcttcccattcagatccattagagggacattaagcggcttagctgctgtgcaaacacaaagatcattctttttt

SEQ ID NO: 82174 - DNA, 201 bp, Homo sapiens
ttggtggcgagacaaagtctcacagtgctgattgcctgtataggggccaaggaacttcctggaggaaaggcagtccaactctagctcctttctcttttttsgctcagttttactcgaacctctctgatggattgatgttgtcccagcagaggtcccttggaaagaaaggactccaaggggcccaaagggaaactcactatg

SEQ ID NO: 82175 - DNA, 201 bp, Homo sapiens
gggcctttctaggctcatgaaggagggcttgtggctgagcctgggtttctggcacagtatcgatcctttgacagtgtatatgagttaaggtaaagcagcartcccctgggatcccaagtgtgaggcatcacagttgtctttgcagggatctggaacaccagggtttgtggcagcaatggacaaaagtaacaactctatggt

SEQ ID NO: 82176 - DNA, 201 bp, Homo sapiens
ataaatgtggttgagtcaatgtggttaagtcagaatagtttgaggaactctaggaatgtggctcagagatgaaggaggtgttggtctttgtgaaaagggcrgataagaagtcttcttttccttatgggctcactgattgtgatgttctcatatagatgctctggcccagcacttaactttatggcaatgttttaaaagcag

SEQ ID NO: 82177 - DNA, 201 bp, Homo sapiens
ttctggcacagtatcgatcctttgacagtgtatatgagttaaggtaaagcagcagtcccctgggatcccaagtgtgaggcatcacagttgtctttgcaggkatctggaacaccagggtttgtggcagcaatggacaaaagtaacaactctatggttttaccaggagctgcagcagctagaaatgtggactcatcttggact

SEQ ID NO: 82178 - DNA, 201 bp, Homo sapiens
cattttgtacatacgagctccttctacagttttctaagttgggtttcaaccatgttgttctgctgcttagccatgtagctctcttttgagatttttaaagrcaattgtttttaggcccagcgtggtggctcacgcatgtaatctctgcactttgggaggccaaggcgggaggatcacttggggctaggagtttgagataac

SEQ ID NO: 82179 - DNA, 201 bp, Homo sapiens
gactatatttttaccccacagttatgaagggagtcatataagtgtattcttcctccttaatgtctttcaaatcctttatctctgtcttaccacattaactsctccttctgcaactagtctcctcagtccatttccacactgctgcaagaatgatctttccagaatgcaaatatgatatgtcactcccctgattaacatcct

SEQ ID NO: 82180 - DNA, 201 bp, Homo sapiens
caacattaaagcctaatacatgggtactgaccttctacctaaaaggctggttttgaatgagtgattttcagtatgagaaatgaatgactcaagaaaagccrtatcagaagaagaaaggtagaaaatgataatggactcaaatgattctccatttgcttctaacattttctttttgaggacttcagtgatttatgccatttg

SEQ ID NO: 82181 - DNA, 201 bp, Homo sapiens
ttagttttgttaactggacagctcttgttaccctttttgctaatatttttagctaattatgtcagcaaaaacttgggttaaatgttaaaattatagtgtartcatagtttcccattccattggaatggtctgacatgtaatgtacagagagcatgcagaatgtctggagtgtatcgtgggacacagctaaagcctgggtga

SEQ ID NO: 82182 - DNA, 201 bp, Homo sapiens
atttttttttcagatgagatgtgttcagtaagcacatacctcattagagagatggcaatggatggctgactacagtcatttcttttctttacccttaaacyacatgtaacccagaattgaaacatatacttgtattgaggttttccaaaacaattagtgatagagatcttaagaaggaccagaattcctggagggtgttgt

SEQ ID NO: 82183 - DNA, 201 bp, Homo sapiens
attgctgttgctttatattaaattttaaaatcagcttatatgatttttccaatcttatttttcctttatcaaaattgttttggttattccagttcttctgkcttttcatataaattttagaatcagcttgtctgtacctacagaaaatcatgctgggatttttattgggattgcataaatttatagataagtttggtgaga

SEQ ID NO: 82184 - DNA, 201 bp, Homo sapiens
gaatcggagttaggaagaatgtatataaaaatgtctcttctgtgttgtaggagggattcaaatgttatgggagcccaaaagatgtagtaattaattttccytggatgcagctggggtcatgctaatgaatgaagctttcgatgggagtggtgggagaaggggaaggcttaatagaagataggacttgcaacaaatatttaa

SEQ ID NO: 82185 - DNA, 201 bp, Homo sapiens
aaacacagaatgacagatcgacatagttgattaacgcagagtttcttgcttcactgtttataccctttattattaaccagaggctccaaattgctgatgcygtattttatttaatttttaagtttactggggttaataagtaagtgagattcttctaacagtttcactttccacattgtgaatataatctctctgggaaat

SEQ ID NO: 82186 - DNA, 201 bp, Homo sapiens
ctctacattcgtatttcaggtcagagaagaacaccatttcttgagagaagacaaacaaccctagtctaccaccagcataggttttatcatagatgggtccygagtcagccatgattttcttcccttcatacatcaccactctgcagggaaaaaaaatcttgtttagtgacaatgctatttaatactttttgtctttttgtc

SEQ ID NO: 82187 - DNA, 201 bp, Homo sapiens
tttttgaataaagggcttaaaagggtcacacaatcctcttctgataagcctatgctttccatctcactcctgggggcatctaaggatagacagagaccggkgtaaatcccacttaagtcaagctctacatgtgctaccagagactaagaaccaggcctttactctgatgtctacacttaaattctttttttaagctttgta

SEQ ID NO: 82188 - DNA, 201 bp, Homo sapiens
gaaagactagacatgaactgtggcctagcacccaccagcctcaactttcactagttacattactagacaccaaccctcaacacctgccttttcaaactcaytaattcctctgacaggctttgcccctcttgcttcaggcctttgcctaaattgatttctaattttggaatgtcctttccctttccttttatgcctggttaa

SEQ ID NO: 82189 - DNA, 201 bp, Homo sapiens
tttattttcaaccccgttcttcactctacagacattctggtcatgttattctctgcttctcaggactttaataaagcctgaaagactagacatgaactgtkgcctagcacccaccagcctcaactttcactagttacattactagacaccaaccctcaacacctgccttttcaaactcactaattcctctgacaggctttg

SEQ ID NO: 82190 - DNA, 201 bp, Homo sapiens
gtttgggttctttagaagcactgccaagatagaatttggggtacaggatgtttattaggaatcattacttgtaaaaggaagggggaggaagcagttttggrtagagagaggagctgaactgccatgcaggcctggcaagccttgtgaatgcagcaagggtttctagtcagtggcggcctgtgtaggctgaagtggacagcc

SEQ ID NO: 82191 - DNA, 201 bp, Homo sapiens
tccaaagtaagaaagcacagtgtcatggtttgggttctttagaagcactgccaagatagaatttggggtacaggatgtttattaggaatcattacttgtaraaggaagggggaggaagcagttttgggtagagagaggagctgaactgccatgcaggcctggcaagccttgtgaatgcagcaagggtttctagtcagtggc

SEQ ID NO: 82192 - DNA, 201 bp, Homo sapiens
gatagggtgcaggtcccctccttgcttttcgttttcaaaagtatcttggctgttttaccatgtgaattttaaaatcaccttctcaagttccatgaacgacscatgtacgattttgactagaattgtacttaattttggccggatgcagtggctcacgcctgtaatcctagcactttgggaggccgaggcgggcggatcaca

SEQ ID NO: 82193 - DNA, 201 bp, Homo sapiens
gtttttcttgttattatagaagttctttatatattcttgattctaatcttttggtggttatacagatgggagctatcctctcccagtttgtagcttttttycactttttataaggtgacttttgatggtcgtatgtccttgtttttaaaagagtcaaatttactaatactgtatcttgttttataatgggtacttttgtgt

SEQ ID NO: 82194 - DNA, 201 bp, Homo sapiens
gttatctgagaatagaacttcctaagaattcataaaaggcaaatttagcttgttttaattaacaaagagaaaaactgattcaaagacactaaacagcttastaaactctgctgaagaatgaacctgtgtatatggatagctgaacacccagacaagatccattcttttcaattctgttttgagacctttgtagtagggact

SEQ ID NO: 82195 - DNA, 201 bp, Homo sapiens
gatgaggatgtttggtaaggatgacactcagcgggctctttctaaatcgtagggaattgtctacacattatatgtaattttacataagcaaagtttgaaartgtgttttaggtatctaatgtcatagaaggacttccttcattttctacttgactaggtttccatagtagggtggagataatgctcctgattctggataca

SEQ ID NO: 82196 - DNA, 201 bp, Homo sapiens
ttttttgtgagaaacattaaacttgtaaaatgttcacaactgctcctatttaaaaaagttctgtgtgggcaaacaaaatatccctcccttccaccaaaaarcaaaaacatatctacagaatatcacacataataatcctctaaataatccttcctgagatggtgaggtcccagcgggggctgtgtctaggagcaggtgaag

SEQ ID NO: 82197 - DNA, 201 bp, Homo sapiens
cgtattagacctttgactgcccatcccagtgtgagctcaaggagcaggcccgtctgccttatcccagagcccggcagatagcagttcccttcaggactgaygtagactcttctccattattgctagggattgctggagaatggtgcaaatgttattacatggaattgtgtagttaaattacatttaattagagtgttatat

SEQ ID NO: 82198 - DNA, 201 bp, Homo sapiens
tagttaaattacatttaattagagtgttatatttctagaatactttaatgctagtgtatgcatttatgtacattctccatctgcttccattagtgtcaaartattctagaaatgtaaagtttaaaaaaagacagtattttcggaaactgttttttttttgaaattatttttaggtcgatactgcaagcaacttgaactctg

SEQ ID NO: 82199 - DNA, 201 bp, Homo sapiens
tatttctagaatactttaatgctagtgtatgcatttatgtacattctccatctgcttccattagtgtcaaaatattctagaaatgtaaagtttaaaaaaaracagtattttcggaaactgttttttttttgaaattatttttaggtcgatactgcaagcaacttgaactctggtaaagaggaccactccgaaagcagtaat

SEQ ID NO: 82200 - DNA, 201 bp, Homo sapiens
tactagtctggcctatattaaattcatagatcatttactttttgcatcttctgtttcgttacggaggtaacacatgtataatctatataagaaaatattgrttaaacaaaaaaaattactatcagctaaattctcaacttgtagagataaccactattaatattttagtttactctttatcttttgagatgtgtttaatgc

SEQ ID NO: 82201 - DNA, 201 bp, Homo sapiens
ctgtctctgtgaatttgcctagtctgaacatttcatataaatggaatcatacggcatatggccttttgtgactggcttcttacattatgtcttcaagattyatccatgttgtagcatgtatccatactccactcttttctattgttgaataagtctcaattatatggatatatcacattttgcttatccattcatcatttg

SEQ ID NO: 82202 - DNA, 201 bp, Homo sapiens
gcatttatgtacattctccatctgcttccattagtgtcaaaatattctagaaatgtaaagtttaaaaaaagacagtattttcggaaactgttttttttttdaaattatttttaggtcgatactgcaagcaacttgaactctggtaaagaggaccactccgaaagcagtaatacagagaacagaagaactagtaatgatgat

SEQ ID NO: 82203 - DNA, 201 bp, Homo sapiens
ttaagtctagagacacaatggtccagagatccctgtgaaagggagccctcatccggggagccccagcttgcacagtcaccccctcaccccttcctggggakcagtgagaatgccgtgggctgtgcctgcactgagaatgctgcttttctgtgaaaacacagtcaagtgcacatgataggttttagttcccaagcagtgtta

SEQ ID NO: 82204 - DNA, 201 bp, Homo sapiens
aaatggtcagtaatatttaagacataagtatctgcaaagaaagtgaattatggaaagtaaattacagtatatcatttgtataaaggagaaggtggttggaracttgtccaggaactatattgagaccattttatttgcatttctatataatatgcatgcctttcagctttccgttaaattttggcccccaaattattaaac

SEQ ID NO: 82205 - DNA, 201 bp, Homo sapiens
tcatttgtataaaggagaaggtggttggagacttgtccaggaactatattgagaccattttatttgcatttctatataatatgcatgcctttcagctttcmgttaaattttggcccccaaattattaaacttttatacttgcaactgggccccaacatttaaaaaaaatcctgtttgtgtctggacacacaattcattttg

SEQ ID NO: 82206 - DNA, 201 bp, Homo sapiens
cttcccctgtcagtttgtcggcgcaacaggtcagacaaatgcacaaggccttacaatatttgtcttgatgtctttggcttgtaaagctagattttaagatwttcagggttccttattccttagccgttagcgtttttggacttcttggctactgtaataattattctgaaccattctccatctttcttaaaagtttaatat

SEQ ID NO: 82207 - DNA, 201 bp, Homo sapiens
caataggatgactgtcttcctatgagaatatgagaatccacctgtcttcccttcatccagatattacaaatttaaacaataccactcttctcactaatttktttgagaatatagttatttgttataaaatgtgatacttatgttaacataattagtaatagcatgttttttatttttgaaagtgaattaataagtaaatat

SEQ ID NO: 82208 - DNA, 201 bp, Homo sapiens
taaaaaccttttgctggcctatcagtgaatcaattctccactgtttaattttagtagcttttgtggtttggtttgtatggactatacagggaagcagactsaggctatgtgatttcagattgttttccaatagggatggaatgttttcatcagatgagcccagaattctgatacagttattgactttagggagtgataacg

SEQ ID NO: 82209 - DNA, 201 bp, Homo sapiens
ttggaaacaactgtatttgttttctagtgtatattattttaaaatattttagaatatttttgtaaggtatgtttcccgattacattactctaaatacgaaygtttttatatttccaataaaatattcactaatatttacctttccaatgagatattttacttgcatgactatttttaaagtatgtgctcattttggtggag

SEQ ID NO: 82210 - DNA, 201 bp, Homo sapiens
gaaattaaagtcattgaaattcatgattaagttttcttatggggacttcttgttctcagataattcatccccctgtaaaggaggattagtcttttcctagrtaatccacatgtaaaccatggaagacactgattttttggggaagtagacatttttttttcagtgtgtttcactatattttaatctcattcctttttgaga

SEQ ID NO: 82211 - DNA, 201 bp, Homo sapiens
agatctatctatatttttgtatgcagtggtgcacccttttttaggactgtataacattccatagtgagaatgtacctaaatttatttctgcattttctcaratagacatttgggttattttcagattttcgttatgaatgctactgtgataaacattcttgtacatgttatctgctctacatgtacaaaatttcctctagt

SEQ ID NO: 82212 - DNA, 201 bp, Homo sapiens
tgagtctgtttttgaaaactgcattttcttgaggcaggtcgcacgttctaggagtccacactgatgcaagcacagaaaagaaggaagccaaggagaagtgrtcctgggggttttctcaagcccatagttccagaaggtgcaataccagcattggtttatgatcagtctttcaatcaacaatttgatgattagggatctgtt

SEQ ID NO: 82213 - DNA, 201 bp, Homo sapiens
aatgaataattgaacattataatgaaaaattttggcaagttaatgaattcatactcattttttttttgtttgtagactagattctgcattatggaactctwagaattctgtctgtcatgatgtggttcaggaatagcattctatgtatttcaagcagaaggggattgaatacaagagttaaagcctgggcaacattgtgag

SEQ ID NO: 82214 - DNA, 201 bp, Homo sapiens
cccatgacaaagcccacttggtcatggtttgtatcaagttttgaagttccagctggaaatctctaataagggaccagccagcagagaacaagtaggcttgkgtttggaccagtgttttggaaacagttggctcactgggctagtgaccaccctgttaacttctgctgacctgttttccaagaacccacctggtaccaacat

SEQ ID NO: 82215 - DNA, 201 bp, Homo sapiens
ggttgcactgagccaagatcacgctattgcactcccactccagcctgggcaacaagagcaaaactctgtctcaaaaaaaaaaaaaaaaaaaaaaaaaaaargaaaagaaaagaaagaaagaaaggtgaaagggcattgggtgtcaaaagcaggagtgttattgagtaagaggctgcaaagcagggaaggacacagattgga

SEQ ID NO: 82216 - DNA, 201 bp, Homo sapiens
ctcacgcctgtaatcccaagactttgggaggccaaggcgggtggatcacctgagggcaggagtttgagaccagcctggccaacatggtgaaaccccatttytactaaaaatacaaaattagctgggtgtggtggcacatgcctgtaatcttagctacttgggaggctgaagcaggagaattgcttgaacccaggaggcaga

SEQ ID NO: 82217 - DNA, 201 bp, Homo sapiens
cttcggttcctgacacaagactttctaagacccttggactctctggagtgaaaagagtgtcttgtttgctaatgagatgactggtgactggaggctcctakataatttcaggatgaaggctggtcactggaaagaccaaagcatgattagaaggttggaactttcagtccaccctagatgtccagggaggggagagggtct

SEQ ID NO: 82218 - DNA, 201 bp, Homo sapiens
tgcaagactgttaaaaattcccgactagtaataacatgaatgcactttatggcttcaaaaggagataaaagaaatttcttagtcagcactttggcggcatmacagctaatgtcagttttgttattgtgaggactttacttttggcagatgctctcccttctggcagcagagctctaattaccatataaattaagctgggaa

SEQ ID NO: 82219 - DNA, 201 bp, Homo sapiens
atttgtttgtttattttttttgagacggagtctcactggctggagtgtagtggcgtgatctcggctcactgcaacctccacctcccaggtttaagcgattytcctgcctcggcctcctgagtagctgggattagaggcacccaccaccatacccagctgatttttgtatttttagtagagacggcgttccccatgttggcc

SEQ ID NO: 82220 - DNA, 201 bp, Homo sapiens
cagatgtatgggcagataaatgggctaagaaagagattatgtgattgattatgacctttctatattgtacctgacttacattaagtatgtttttaatactyaaaactagtttactaaaaatgcctttaaaaatgagtctttatatatatatatcttttttttattttttattttatttgtttgtttattttttttgagacg

SEQ ID NO: 82221 - DNA, 201 bp, Homo sapiens
aaaaaaccacatttgatagaaaaaaaaaaaaaaaaagtagttttaaaagcatggctgagctggcagaaatgtaagggaattccttggagggtaggaatgamaagacactatgtgtcaggaggggtaagtgaccattggaacaagcattggtccccgtggtatctgttaacctctaaaggcctaaagtgtgggttttaacca

SEQ ID NO: 82222 - DNA, 201 bp, Homo sapiens
tgcacatgccagaggtctagtttgcatgctccttgtgaaaatctaatgcctgatgacctaaggtgggacagtttcatccaaaaaccatacccctcccccamccctccccctattgcctaaagggttggggaccactgtctgagagacttcatttcattgctttaaaatcaagagagtagtgcaagatgacctctgttcttt

SEQ ID NO: 82223 - DNA, 201 bp, Homo sapiens
tcacagctcactgcagcctcgacctcccaggttcaagtgatcctcccacctcagcctcccaagtggctgagactgtaggtgttaccgtgtctggctaattwtttttttattttttattttgtagatatggggtctcactgtgttgcccaggctggtctctaacttctgggctcaagggatcctcctgacttgacctcctgg

SEQ ID NO: 82224 - DNA, 201 bp, Homo sapiens
gtgtcttgtcgtgatcctcccctgccaagactcacacactgtttggtttcactgaaatggactgtgaatgccagggtcaagaggataaaaatataaaagtytttgtgcataaagtttttacctataatgcctctgattatcacctagggcttagttcctggtattaacatcgtgaaatcaaaatgtatgaaataagtttct

SEQ ID NO: 82225 - DNA, 201 bp, Homo sapiens
aaccaggtttgtacaccgggcagatgtccaggcagccataaacatggctttaggaacagcctggttaggggctggctgctgtggctccgcagccaccagaygtttgctttccacgagatgctcattgctgccaccatcactgtccctgttaatcatttccctgcacctttgcttctgtccctcaaggtttggggtgtttgc

SEQ ID NO: 82226 - DNA, 201 bp, Homo sapiens
ctgggactacaggcgcccgctaccacgcccggctaattttttgtatttttagtagagacggggtttcaccgtgttagccaggatggtctcgatctcctgayctcgtgatctgcccgcctcggcctcccaaagtgctgggattacaggcgtgagccaccgcgcccggcccttagacttttcttataaaaattggtggcaata

SEQ ID NO: 82227 - DNA, 201 bp, Homo sapiens
gcaaattttagagtagcatagaattagtattcctgcttatttatttctgggtgacaatttttttaagcagcaacttcatgatattgataacttacacataytttaatacacagattaatattacttcattcaagacttattaaaaggagaatatcagtgatcacgtaaactcagattttatttgaacctactaagctacag

SEQ ID NO: 82228 - DNA, 201 bp, Homo sapiens
ggtatatctagaaacacactttgtgaatgtgaaaggttctcttgtacccaactagaaataatcactgactgcctctgaagataatgatggagaatttgttraaagatttctctttaattataaagtggctatgcaaatgtgattacagtttaaatttattttcgtagtgaaaatagcttttgggggcattcaggcattcta

SEQ ID NO: 82229 - DNA, 201 bp, Homo sapiens
gctctccagtaggaatggctattatacacaaaatccagtgtgtagaatctacgatatgaggcttaatgagatccctctcctaccatattgttacattcggytgaagtttatggtgaggaaagggcaaccggggcaacaaggctgaaatggtagttggtgcccagatggcaaacaatgctcttgctcgctttcattcattca

SEQ ID NO: 82230 - DNA, 201 bp, Homo sapiens
tttcattctattcctttgcagataatcccatgtcacccttaatcccttacaattactgatctattccctgtctctcttctttttccttttccagaagtttrtataaatggaatcatacagtatgtagcttttcacgctggcttttatctcctagcatacttaatacatttgagattcatccatgttaatacatgtggctga

SEQ ID NO: 82231 - DNA, 201 bp, Homo sapiens
gtatctaatacatggaatgaggtttcaggccctgcctccactgaggcgcttcccactgggaagtactagagaatatttttaaagagtctctgtggacacasagcaagttttaggtttttttgtttttgtttttgtttggtatatctagaaacacactttgtgaatgtgaaaggttctcttgtacccaactagaaataatca

SEQ ID NO: 82232 - DNA, 201 bp, Homo sapiens
gggaggctgaggcaagaggatagcttgatttcaggagttcaaggctgcaatgagttgtgattgtgccactgcactgcagcttgggtgacagagtgaaactstgttccccctccacctcccccactgcaaaaaagagtttagttcctcaaaatcaacagaagacctcaaaatcaacaggtgaccagcaagaaagggagttca

SEQ ID NO: 82233 - DNA, 201 bp, Homo sapiens; identical to SEQ ID NO: 61215

SEQ ID NO: 82234 - DNA, 201 bp, Homo sapiens
cccacccactccaggaacccagagccacattagaagttcctgagggctggagaacactgctgggcacactctccagctcaataaaccatcagtcccagaarcaaaggtcacacagcccctgacctccctcaccagtggaggctgggtagtgctggccatcccaaaagggctctgtcctgggagtctggtgtgtctcctaca

SEQ ID NO: 82235 - DNA, 201 bp, Homo sapiens
gcatgaccagccttcctggtggtccccagagcagggtcaggggcatcgatcggatgggagtgggaatgctgtatctatagccctccaaatcagaagagacrggaattcacaggcctcgagtcccagtatttttattgaagtctgaagaaacaagttccagaaaacatgttaaacttccttctgggagctgggattggtggt

SEQ ID NO: 82236 - DNA, 201 bp, Homo sapiens; identical to SEQ ID NO: 61216

SEQ ID NO: 82237 - DNA, 201 bp, Homo sapiens
gccagggctgcgtggaggggggaggctgtctgttctgggagctgggactgggtaccgggggaaggagggctgctgcaggctctgggtgcctggggcctggstcctgcagggcgggcctgtgagagtggttggggccagtggaggggctgggagcattccaggggaacattccaggcgccctctgagtaatgcttggctctg

SEQ ID NO: 82238 - DNA, 201 bp, Homo sapiens
gaatgccagctattatctgcgtccctggccaccccggggctccaaggacttctcaacccacgagatctttcggatggagcagctgctcacctggaaaggarcctgtggccacagggatcctgggaacaaagcgggcatgaccagccttcctggtggtccccagagcagggtcaggggcatcgatcggatgggagtgggaat

SEQ ID NO: 82239 - DNA, 201 bp, Homo sapiens
cgcgccgagagctcgggaggcgtgagcacggtgagccccgcgggcgggggcgagggagagacaggaggctctacggccgcagtgaccgccctcccacggcyccccaggaccactcggagctccccatcggcgccgcagccaccatggcccatgagatcggccacagcctcggcctcagccacgaccccgacggctgctgcg

SEQ ID NO: 82240 - DNA, 201 bp, Homo sapiens; identical to SEQ ID NO: 61223

SEQ ID NO: 82241 - DNA, 201 bp, Homo sapiens
acccatggggtgccctgaggaccacacggggtggtggttggcggggtggtggttggtggggtggtggctgacggggtggtggctggcaggccgagcctagrtggcagccagagccccaggcatgtgtctgggcacaggacggtgttgcctagtttgaacaccctctttgctctgtcactcctgcttcccttgggcgttcac

SEQ ID NO: 82242 - DNA, 201 bp, Homo sapiens
cattgcaattgagctcattcaagcaaagctatcttcagcagggacttctccctctaggcagcaagcgcatttttattttacctgtcctcaaactgatcctktgctccttataatagtaaggaacacacccctgtgtggagatttaagatgctaatgaggccaagcgcagttgctcacgtctgtaattccagcactttggga

SEQ ID NO: 82243 - DNA, 201 bp, Homo sapiens; identical to SEQ ID NO: 61230

SEQ ID NO: 82244 - DNA, 201 bp, Homo sapiens
caggagggggtgtctagaccccgcgggactccagctacaagggaccctggggaggccaactctgccctcttggctattccccaagactgcccagcaccccytccaccccttctccattcagtggcgaaccctggggaggccacgtgggaaggaaagagggctctaagaggggaggccccagactgggggagaggcctgtct

SEQ ID NO: 82245 - DNA, 201 bp, Homo sapiens
gaggctgtctgttctgggagctgggactgggtaccgggggaaggagggctgctgcaggctctgggtgcctggggcctggctcctgcagggcgggcctgtgrgagtggttggggccagtggaggggctgggagcattccaggggaacattccaggcgccctctgagtaatgcttggctctgggattcctcctagagccccct

SEQ ID NO: 82246 - DNA, 201 bp, Homo sapiens
tatacctcccccgctcttacccttcaggagggggtgtctagaccccgcgggactccagctacaagggaccctggggaggccaactctgccctcttggctawtccccaagactgcccagcaccccctccaccccttctccattcagtggcgaaccctggggaggccacgtgggaaggaaagagggctctaagaggggaggcc

SEQ ID NO: 82247 - DNA, 201 bp, Homo sapiens
gaagagacaggaattcacaggcctcgagtcccagtatttttattgaagtctgaagaaacaagttccagaaaacatgttaaacttccttctgggagctgggrttggtggtcagggctcaagcccagcagcttccactcagggtccccatttgcacctccgcagggcaggcgagaagcgcgcaggacccggaagtacctggaa

SEQ ID NO: 82248 - DNA, 201 bp, Homo sapiens
ggtgctgggcttgggtaggcctggctcccccagctccgagccgcgctctcggcatggacctctcactgcacgtggcctctctctgccttccccaccacccstcacctgcgcagctgaagccggctggagcgctgtgccgccaggccatgggtgactgtgacctccctgagttttgcacgggcacctcctcccactgtcccc

SEQ ID NO: 82249 - DNA, 201 bp, Homo sapiens
gggaccattctaagccctcgagctatgttcatccttcctgcagaggcaggtgctgaagtcacagcaggaatcactctcaccacgcggtccaatccacagcytgaaagacacagccattgccagagaggcaccctgctcccagccctggggggggataccaccccgtagcccctgtgcacaaacacacagggagatggatga

SEQ ID NO: 82250 - DNA, 201 bp, Homo sapiens
ctgggcaaggtggacctcgcaaggcaacatctggctgttgtttttctcagatgatggggggggcacaagtgtcctctcttcgtacatctctcaccctaaargcatctgctgcccatctaaaaatccctaaggctgccgcgctctttccttcccctctgcactggcggccttggcctcttccttgtgatcgccgagcccaag

SEQ ID NO: 82251 - DNA, 201 bp, Homo sapiens
actaaggtctgaacgattttaaaccattggctacacccctgcccctcctagagagccctctttgtttggaattttcagccctactgtccaaatccagcaaragggaaggcaggggagcattgccatgaaggctgagaggcccccagagacccagcagctcccaacccagggccctcactgggatcccctaggcccataagg

SEQ ID NO: 82252 - DNA, 201 bp, Homo sapiens
ctttggaagagggagcagtttgccaaaattggaagtggaggagtcaaatttgaattctatagggaatgagcagcagctcatttggaaacaagcctcaggtrgcagaggctctgaggaggccctgaccatggctacccgatgcccccataatgtcctcagcacccctctgtcttcccctgcttttgatgccccttctgggca

SEQ ID NO: 82253 - DNA, 201 bp, Homo sapiens
aggcccaggaaaactttggaagagggagcagtttgccaaaattggaagtggaggagtcaaatttgaattctatagggaatgagcagcagctcatttggaamcaagcctcaggtagcagaggctctgaggaggccctgaccatggctacccgatgcccccataatgtcctcagcacccctctgtcttcccctgcttttgatg

SEQ ID NO: 82254 - DNA, 201 bp, Homo sapiens; identical to SEQ ID NO: 61241

SEQ ID NO: 82255 - DNA, 201 bp, Homo sapiens
aaccatcccaaaactgagtgcagggaggcaacttcacctcgggctccactccacaagcccaaggggccaggtgagagtgctctctaaagccccctcctgcytcagttgtagttgcaaaattttaatttatgaaggtgactgatgacacagaggccaatgctgttgaaataagttattactcacagtttcccaccatgcagg

SEQ ID NO: 82256 - DNA, 201 bp, Homo sapiens
ggcaggccgagcctagatggcagccagagccccaggcatgtgtctgggcacaggacggtgttgcctagtttgaacaccctctttgctctgtcactcctgcytcccttgggcgttcacattctcccattgcttcatgcaagagctgctgagtggcctatatcagccagctgttgccgcataacaaaaccatcccaaaactga

SEQ ID NO: 82257 - DNA, 201 bp, Homo sapiens
ggggttgggggactgtccctccatgcccaatgccctccccgtgccggtaggcacccgtttccgcgcgtgttcagcgcctgcagccgccgccagctgcgcgycttcttccgcaaggggggcggcgcttgcctctccaatgccccggaccccggactcccggtgccgccggcgctctgcgggaacggcttcgtggaagcgggc

SEQ ID NO: 82258 - DNA, 201 bp, Homo sapiens; identical to SEQ ID NO: 61250

SEQ ID NO: 82259 - DNA, 201 bp, Homo sapiens
ttccagaataaccatgccccatctgtttgtgccataatatctgtgctgcaaactaagagggcagtagccttgatatgctcattttacagaggggcaaacgsaagcccagagagcttggggaaattgtccatggtcacacagctctttaggctgggagcctgagacccactaaggtctgaacgattttaaaccattggctac

SEQ ID NO: 82260 - DNA, 201 bp, Homo sapiens
ctggcgaggttactcctacaccgggaggagcaccgtcgggtcgcgattccaccttgggtcccgggctgctcactattggggccgcatcgtcccctgtcccrcttgttgtgtgactttgcgcgggttacttcccctctctgggctctgcgcgtctggcggctgtagccaagcccaggggtggggatcagagaagcgcggggg

SEQ ID NO: 82261 - DNA, 201 bp, Homo sapiens
gtcggatggacagggaacaaactctagttccactgtgcccaaccatattttcccgacgtccctaccctttcaatggggtggtcacatcacctacctcctarggtggcgggtgtgtgtggggcaggggtagggggcagagctggggcaggtggtggaatgcctgggaggggggaagcagccatcattagcgggtggtctgga

SEQ ID NO: 82262 - DNA, 201 bp, Homo sapiens
ttgtgtgactttgcgcgggttacttcccctctctgggctctgcgcgtctggcggctgtagccaagcccaggggtggggatcagagaagcgcgggggttggrggactgtccctccatgcccaatgccctccccgtgccggtaggcacccgtttccgcgcgtgttcagcgcctgcagccgccgccagctgcgcgccttcttcc

SEQ ID NO: 82263 - DNA, 201 bp, Homo sapiens
ctagttccactgtgcccaaccatattttcccgacgtccctaccctttcaatggggtggtcacatcacctacctcctagggtggcgggtgtgtgtggggcargggtagggggcagagctggggcaggtggtggaatgcctgggaggggggaagcagccatcattagcgggtggtctggaggtaatgaggccaaggtgaggtt

SEQ ID NO: 82264 - DNA, 201 bp, Homo sapiens; identical to SEQ ID NO: 61251

SEQ ID NO: 82265 - DNA, 201 bp, Homo sapiens
ggatcctgctgcctgctgcaggtcccctgggaaccacaaactcttcccctattcccactcctccccggcgtcctccctggtgcttcccatattcacacctyccacaactaagccatcaccaaggctccttcctctagccccaagagtttctgatctgagcaagtcaccattgctcctgtcccttccctaagacacactgtg

SEQ ID NO: 82266 - DNA, 201 bp, Homo sapiens; identical to SEQ ID NO: 11825

SEQ ID NO: 82267 - DNA, 201 bp, Homo sapiens; identical to SEQ ID NO: 11827

SEQ ID NO: 82268 - DNA, 201 bp, Homo sapiens; identical to SEQ ID NO: 61263

SEQ ID NO: 82269 - DNA, 201 bp, Homo sapiens
taggcagggacctggattcaaagcctccccctctcatcgcccaccctcccacctctcccacccctcagtttgctgccccctaatcaggtttctgggctcargttattatggaaatgagtttatgacctcttggttatcatgcagaccaggatgctggaagcccctgggctggggagggagaagctgtggcttttcctggat

SEQ ID NO: 82270 - DNA, 201 bp, Homo sapiens; identical to SEQ ID NO: 61264

SEQ ID NO: 82271 - DNA, 201 bp, Homo sapiens; identical to SEQ ID NO: 61267

SEQ ID NO: 82272 - DNA, 201 bp, Homo sapiens; identical to SEQ ID NO: 61268

SEQ ID NO: 82273 - DNA, 201 bp, Homo sapiens; identical to SEQ ID NO: 61269

SEQ ID NO: 82274 - DNA, 201 bp, Homo sapiens; identical to SEQ ID NO: 61270

SEQ ID NO: 82275 - DNA, 201 bp, Homo sapiens
ccactcaggatcactgtgccaacctcctggactcttatcacgttgctcagccccaaagatggcccacacagggaccaccccctgggcggcgttcaccccayggagttgggccccacagccactggacagccctggcccctgggtgagtgaggcaccagggggaggtggagagggaagggagaagggaagggctcatgcctc

SEQ ID NO: 82276 - DNA, 201 bp, Homo sapiens; identical to SEQ ID NO: 61271

SEQ ID NO: 82277 - DNA, 201 bp, Homo sapiens
tctggggcgctgcgccctcacctgggcccttcttgcctttctggtcccaggagtgccgcgacctctgctgctttgctcacaactgctcgctgcgcccgggrgcccagtgcgcccacggggactgctgcgtgcgctgcctggtgagggcatggaaggttcagggtgagggtttcggggagcttgggagccggcctgttggcc

SEQ ID NO: 82278 - DNA, 201 bp, Homo sapiens
gaccatattcacaacatttaccctccaccatttctcccagaccctgagaactctcatgagcccagcagccaccctgagaagcctctgccagcagtctcgcytgacccccaaggtaggcagggacctggattcaaagcctccccctctcatcgcccaccctcccacctctcccacccctcagtttgctgccccctaatcagg

SEQ ID NO: 82279 - DNA, 201 bp, Homo sapiens
ctggtgtgtctcctacatgcaatttccacggacccagctctgtggagggcatgactgctggccagaagctagtggtcctggggccctatggttcgactgartccacactcccctggagcctggctggcctctgcaaacaaacataattttggggaccttccttcctgtttcttcccaccctgtcttctcccctaggtggtt

SEQ ID NO: 82280 - DNA, 201 bp, Homo sapiens
aggttagtttcctagctgtaatgattggactatgattaagtaagatggaccatcaggggaagctgggtgaagggtgtaaggaaaatgcttacattttccamcttttctgcaagtctaaaattagtcaacaataagaagtttaaaataggccaggcatggtggctcacacctgtcatcctagcactttgagaggccgaggtg

SEQ ID NO: 82281 - DNA, 201 bp, Homo sapiens
ggtcggggctgcggcggggcggctagtcctggggacttcctccgctgcgtttctttggtcgtccctcagtttcctcttctgtaaaatggggataatgatcmtagtgtccgcttcagggtggtttatgaggcttaaagggaagaagctcaggcaaagtggattctcaacggtatgaagattattttccgagtaacctggcga

SEQ ID NO: 82282 - DNA, 201 bp, Homo sapiens
gtcaacaataagaagtttaaaataggccaggcatggtggctcacacctgtcatcctagcactttgagaggccgaggtgggaggatggtttgagcccaggarttcaagaccagcctgcgcaatagagcgagaccccaactctattcaaaaaaatttttttaagtttaaaatagaattatataaaaaaggaaaagaaaaatgc

SEQ ID NO: 82283 - DNA, 201 bp, Homo sapiens
tgggagacatcctggaggaggcaggaggaagctgaattcagtgttccctgtaacaccccctctcagcaggctgctggccccaggatacatagaaacccacyacggcccagatgggcagccagtggtgctggcccccaaccacacggtgagatgcttccatgggctctgggatgcaccgccagaggtacccccccaccattc

SEQ ID NO: 82284 - DNA, 201 bp, Homo sapiens
accttgggtcccgggctgctcactattggggccgcatcgtcccctgtcccgcttgttgtgtgactttgcgcgggttacttcccctctctgggctctgcgcrtctggcggctgtagccaagcccaggggtggggatcagagaagcgcgggggttgggggactgtccctccatgcccaatgccctccccgtgccggtaggcac

SEQ ID NO: 82285 - DNA, 201 bp, Homo sapiens
aaatcacctctgtcacccacttgaagttcccaaatgctgggcccagcacatcttttcactccataccactggtcagctgcggtgctggctgcccctgtgcyagggccctgccttaacccagttctctgtgacctgggtggtggcggagtggggagtcacataatactaagcatggctgtcctaggactcaccctgcaccag

SEQ ID NO: 82286 - DNA, 201 bp, Homo sapiens
cccctgggaaccacaaactcttcccctattcccactcctccccggcgtcctccctggtgcttcccatattcacacctcccacaactaagccatcaccaagsctccttcctctagccccaagagtttctgatctgagcaagtcaccattgctcctgtcccttccctaagacacactgtgagtgtctcactcataaagctgct

SEQ ID NO: 82287 - DNA, 201 bp, Homo sapiens
attattttccgagtaacctggcgaggttactcctacaccgggaggagcaccgtcgggtcgcgattccaccttgggtcccgggctgctcactattggggcckcatcgtcccctgtcccgcttgttgtgtgactttgcgcgggttacttcccctctctgggctctgcgcgtctggcggctgtagccaagcccaggggtgggga

SEQ ID NO: 82288 - DNA, 201 bp, Homo sapiens
ccttggcactccccagtgcccagctggacctgcttggcctgggcctggtagagccaggcacccagtgtggacctagaatggtgagctctgcccacccgacycctccttgccgtttgaatcccgcaggccagtgtccccctcactgcctggtgcactgcccgtaggtgtgccagagcaggcgctgcaggaagaatgccttcc

SEQ ID NO: 82289 - DNA, 201 bp, Homo sapiens; identical to SEQ ID NO: 61277

SEQ ID NO: 82290 - DNA, 201 bp, Homo sapiens
agctggacctgcttggcctgggcctggtagagccaggcacccagtgtggacctagaatggtgagctctgcccacccgacccctccttgccgtttgaatccygcaggccagtgtccccctcactgcctggtgcactgcccgtaggtgtgccagagcaggcgctgcaggaagaatgccttccaggagcttcagcgctgcctga

SEQ ID NO: 82291 - DNA, 201 bp, Homo sapiens; identical to SEQ ID NO: 61278

SEQ ID NO: 82292 - DNA, 201 bp, Homo sapiens
tgtgggcaggagctggggtggtgcacctgctcaggactcagcgccccttcccccaatccccgcagaccatgacaccttcctgctggccatgctcctcagcrtcctgctgcctctgctcccaggcgccggcctggcctggtgttgctaccgactcccaggagcccatctgcagcgatgcagctggggctgcagaagggaccc

SEQ ID NO: 82293 - DNA, 201 bp, Homo sapiens
aggggaacattccaggcgccctctgagtaatgcttggctctgggattcctcctagagcccccttaggcacacccggccagggagcaccaaggctccgtccrgaagcgtcccctccccttgaagagatgaggaggggccttctgggccagggtaccaaaaccctgccaccaggacagagtccccgagggagctctgggcaag

SEQ ID NO: 82294 - DNA, 201 bp, Homo sapiens
gcaggccctcagccttgcccccaggtgcagagagcagccccagaggccatggaaagaagtagctttgaacaggaggttccagtggcctcccagtcaagcgwgggggtggatccctgccccaccaccagcaccgcaaggcatggccctctacctcccagtacagctcctcttgtccactctcctgcttctcccaccagctgg

SEQ ID NO: 82295 - DNA, 201 bp, Homo sapiens
caagaggagagccccaaaggggctctgcttcccccaccggtgggcccctgcccccaggaagcctgccaagatggtacagaagaaagagtagaggctaggtrtcccctccaaaaggcaggaaacactcacatttcaagatgaggggtatatatcaaggggcagggtaccaggagggcaagagtaaagatagcaggggctgca

SEQ ID NO: 82296 - DNA, 201 bp, Homo sapiens
tggtcctcactgagtgaggatgggctctctgccacacagcttgcagcctggggccccagtccttaggggacaacatatcctcctcattctcagcagatcawgtccagatgccaagatcctgcctctggtgagaggtagctcctaaaatgaacagatttaaagacaggtggccactgacagccactccaggaacttgaactg

SEQ ID NO: 82297 - DNA, 201 bp, Homo sapiens
cctttgccacttcctctgcacaaatcacctctgtcacccacttgaagttcccaaatgctgggcccagcacatcttttcactccataccactggtcagctgyggtgctggctgcccctgtgccagggccctgccttaacccagttctctgtgacctgggtggtggcggagtggggagtcacataatactaagcatggctgtc

SEQ ID NO: 82298 - DNA, 201 bp, Homo sapiens
agcccacgttctccccaagaacttcctccccagccggctccacaggccacctactccctggcaggcaggaggcctggaggccaccatctcagctccacacwctttcttgcccaggtctcgaagccagacatggggctggtggccctggaggctgaaggccaggagctcctgcttgagctggagaagaaccagtgagtgcca

SEQ ID NO: 82299 - DNA, 201 bp, Homo sapiens
gcccacgttctccccaagaacttcctccccagccggctccacaggccacctactccctggcaggcaggaggcctggaggccaccatctcagctccacactytttcttgcccaggtctcgaagccagacatggggctggtggccctggaggctgaaggccaggagctcctgcttgagctggagaagaaccagtgagtgccag

SEQ ID NO: 82300 - DNA, 201 bp, Homo sapiens
tgtggatcctgctgcctgctgcaggtcccctgggaaccacaaactcttcccctattcccactcctccccggcgtcctccctggtgcttcccatattcacayctcccacaactaagccatcaccaaggctccttcctctagccccaagagtttctgatctgagcaagtcaccattgctcctgtcccttccctaagacacact

SEQ ID NO: 82301 - DNA, 201 bp, Homo sapiens
cctttccagccttctcttttcctcctccttgatagctcctcagatccaaggatgcccacgggcgtccctccttctccaggctgagcccacgcgtgttgaargtgaagtctgccccaaaaggcctccagtgcctccctggggatgtcctctacccccctccctctgctttgtcccatgcccctgtgttcctcaggtccccct

SEQ ID NO: 82302 - DNA, 201 bp, Homo sapiens
ggccccacgactccgcgcagctgctcacgtgggtgcctctgacccggacgcgggtcccgggtggggcggcctcacctcccggccccgcctggtcacgccgsgctccgcccccaggggccgcgccttccagggcgccacagtgggcctggcgcccgtcgagggcatgtgccgcgccgagagctcgggaggcgtgagcacggt

SEQ ID NO: 82303 - DNA, 201 bp, Homo sapiens
ctgtgacctccctgagttttgcacgggcacctcctcccactgtcccccagacgtttacctactggacggctcaccctgtgccaggggcagtggctactgcygggatggcgcatgtcccacgctggagcagcagtgccagcagctctgggggcctggtgagaggacacgagcacccttgcaccctgccccccatcctctggt

SEQ ID NO: 82304 - DNA, 201 bp, Homo sapiens
tgagaggacacgagcacccttgcaccctgccccccatcctctggtggggccagttttctactgtggggaagatgggcaggggaaactgaggcccgctgagygcagcccctctccgagctgcccccagcctggcccatgcttcctcaggctcccacccagctcccgaggcctgtttccaggtggtgaactctgcgggagatg

SEQ ID NO: 82305 - DNA, 201 bp, Homo sapiens
cacctgctcaggactcagcgccccttcccccaatccccgcagaccatgacaccttcctgctggccatgctcctcagcgtcctgctgcctctgctcccaggsgccggcctggcctggtgttgctaccgactcccaggagcccatctgcagcgatgcagctggggctgcagaagggaccctgcgtgcagtgggtaggctccga

SEQ ID NO: 82306 - DNA, 201 bp, Homo sapiens; identical to SEQ ID NO: 61280

SEQ ID NO: 82307 - DNA, 201 bp, Homo sapiens
taccacaccctccctcttgcccctcttgctccagccctggctgagatttggggctggccccttcctccctaggatcattgccactaccaagggcgagtaargggcttccccgactcctgggtagtcctctgcacctgctctgggatgaggtgagctctgggagaggaggctgggcctgggatggggaaagagctccctcac

SEQ ID NO: 82308 - DNA, 201 bp, Homo sapiens; identical to SEQ ID NO: 61281

SEQ ID NO: 82309 - DNA, 201 bp, Homo sapiens; identical to SEQ ID NO: 61282

SEQ ID NO: 82310 - DNA, 201 bp, Homo sapiens; identical to SEQ ID NO: 61283

SEQ ID NO: 82311 - DNA, 201 bp, Homo sapiens
acatgtgaccctgtggacacactgctgtccctctcagggccctgccacgaaggcctgaaccttcagcctcactggctcctgtggaatccacttctggtatsgggggggcagtggtcactctcctgatgtcccccagatgtaagaccaccccatgtgcttcttctgcaggacgctctgccccagcctcttcccaatcccgct

SEQ ID NO: 82312 - DNA, 201 bp, Homo sapiens
gcctttttcccggtgcagacctttccccaataaagcaagtggcattccagcctcatgagctcatgctggaggccttgtggggcctgtggccagggaggcarggaccatctgctccccacttgcgaaggaagaactccctccaaagactctgagacccttggacagggccccaggccagtgcatttttggagaaaaggagtc

SEQ ID NO: 82313 - DNA, 201 bp, Homo sapiens
ctctgctggggctgtgggagctggggcaggccctcagccttgcccccaggtgcagagagcagccccagaggccatggaaagaagtagctttgaacaggagkttccagtggcctcccagtcaagcgtgggggtggatccctgccccaccaccagcaccgcaaggcatggccctctacctcccagtacagctcctcttgtcca

SEQ ID NO: 82314 - DNA, 201 bp, Homo sapiens
gactcttatcacgttgctcagccccaaagatggcccacacagggaccaccccctgggcggcgttcaccccatggagttgggccccacagccactggacagycctggcccctgggtgagtgaggcaccagggggaggtggagagggaagggagaagggaagggctcatgcctcctgcctccttccagatgggcagcacccag

SEQ ID NO: 82315 - DNA, 201 bp, Homo sapiens
gcggcaggagaattgtttgaacatgggaggtggaggttgcagtgagctgagatcgtgccactgcactccagcctgggcaacaagagcaagactccgtctcaaaaaaaaaaaaaaaaaaaaagagagactctaaaaatacacgttaatatacctcccccgctcttacccttcaggagggggtgtctagaccccgcgggactc

SEQ ID NO: 82316 - DNA, 201 bp, Homo sapiens
gggccccacagccactggacagccctggcccctgggtgagtgaggcaccagggggaggtggagagggaagggagaagggaagggctcatgcctcctgcctycttccagatgggcagcacccagtcaccttgagtcccctatgcccctccccagccccagggtctcctgctgaccatattcacaacatttaccctccaccat

SEQ ID NO: 82317 - DNA, 201 bp, Homo sapiens
cctgacccccaaggtaggcagggacctggattcaaagcctccccctctcatcgcccaccctcccacctctcccacccctcagtttgctgccccctaatcargtttctgggctcaggttattatggaaatgagtttatgacctcttggttatcatgcagaccaggatgctggaagcccctgggctggggagggagaagctgt

SEQ ID NO: 82318 - DNA, 201 bp, Homo sapiens
ccccatggagttgggccccacagccactggacagccctggcccctgggtgagtgaggcaccagggggaggtggagagggaagggagaagggaagggctcaygcctcctgcctccttccagatgggcagcacccagtcaccttgagtcccctatgcccctccccagccccagggtctcctgctgaccatattcacaacattt

SEQ ID NO: 82319 - DNA, 201 bp, Homo sapiens
agagggaagggagaagggaagggctcatgcctcctgcctccttccagatgggcagcacccagtcaccttgagtcccctatgcccctccccagccccagggkctcctgctgaccatattcacaacatttaccctccaccatttctcccagaccctgagaactctcatgagcccagcagccaccctgagaagcctctgccagc

SEQ ID NO: 82320 - DNA, 201 bp, Homo sapiens
gcctcacccttgacttcgccctgtttttccctggctcagattgcagtccctgtaccatgctgcccccggaggcctgtccagcctctgtctcaccagttttyggccctttgccacttcctctgcacaaatcacctctgtcacccacttgaagttcccaaatgctgggcccagcacatcttttcactccataccactggtcag

SEQ ID NO: 82321 - DNA, 201 bp, Homo sapiens
tagaagtcaaaagaaagacatgttggctataggcgtggtggctcatgcctataatcccagcactttgggaagccggggtaggaggatcaccagaggccagsaggtccacaccagcctgggcaacacagcaagacaccgcatctacagaaaaattttaaaattagctgggcgtggtggtgtgtacctgtaggcctagctgct

SEQ ID NO: 82322 - DNA, 201 bp, Homo sapiens
cagtccctgtaccatgctgcccccggaggcctgtccagcctctgtctcaccagtttttggccctttgccacttcctctgcacaaatcacctctgtcacccmcttgaagttcccaaatgctgggcccagcacatcttttcactccataccactggtcagctgcggtgctggctgcccctgtgccagggccctgccttaaccc

SEQ ID NO: 82323 - DNA, 201 bp, Homo sapiens
caattcactcatccaatcaaggagggcttcttggaggaagggtctttgatgtttgtagtctgggagagaaggtggaggagaaaaaaggagttggggtggcytagcaggagctgagtcacttccacaggcagccatcagcccagcaggactgaggccagggctgcgtggaggggggaggctgtctgttctgggagctgggac

SEQ ID NO: 82324 - DNA, 201 bp, Homo sapiens
cgctgcagagggtggcggctgcttctcatccccaggcgggagtctcagggcaggggagaatgttttgaaggaacatcacaggaaatgacaaggccttgggrgatgggatggggacagtcaaagatggcttggaatcatcaagggcagcagggcacccaggggcaaggagagcagacatagctgccgaaggggcggacatcc

SEQ ID NO: 82325 - DNA, 201 bp, Homo sapiens
caccctcccacctctcccacccctcagtttgctgccccctaatcaggtttctgggctcaggttattatggaaatgagtttatgacctcttggttatcatgsagaccaggatgctggaagcccctgggctggggagggagaagctgtggcttttcctggatcactggtcctcactgagtgaggatgggctctctgccacaca

SEQ ID NO: 82326 - DNA, 201 bp, Homo sapiens
gacctcttggttatcatgcagaccaggatgctggaagcccctgggctggggagggagaagctgtggcttttcctggatcactggtcctcactgagtgaggrtgggctctctgccacacagcttgcagcctggggccccagtccttaggggacaacatatcctcctcattctcagcagatcaagtccagatgccaagatcct

SEQ ID NO: 82327 - DNA, 201 bp, Homo sapiens
ggttatcatgcagaccaggatgctggaagcccctgggctggggagggagaagctgtggcttttcctggatcactggtcctcactgagtgaggatgggctcyctgccacacagcttgcagcctggggccccagtccttaggggacaacatatcctcctcattctcagcagatcaagtccagatgccaagatcctgcctctgg

SEQ ID NO: 82328 - DNA, 201 bp, Homo sapiens
gggctggggagggagaagctgtggcttttcctggatcactggtcctcactgagtgaggatgggctctctgccacacagcttgcagcctggggccccagtcmttaggggacaacatatcctcctcattctcagcagatcaagtccagatgccaagatcctgcctctggtgagaggtagctcctaaaatgaacagatttaaag

SEQ ID NO: 82329 - DNA, 201 bp, Homo sapiens
ggaaccatttaagaaaagataccaaagtagaagtcaaaagaaagacatgttggctataggcgtggtggctcatgcctataatcccagcactttgggaagcyggggtaggaggatcaccagaggccaggaggtccacaccagcctgggcaacacagcaagacaccgcatctacagaaaaattttaaaattagctgggcgtgg

SEQ ID NO: 82330 - DNA, 201 bp, Homo sapiens
gggtggtttatgaggcttaaagggaagaagctcaggcaaagtggattctcaacggtatgaagattattttccgagtaacctggcgaggttactcctacacygggaggagcaccgtcgggtcgcgattccaccttgggtcccgggctgctcactattggggccgcatcgtcccctgtcccgcttgttgtgtgactttgcgcg

SEQ ID NO: 82331 - DNA, 201 bp, Homo sapiens
ttggttagtcttttctgtatgtaaattcaacccatggggtgccctgaggaccacacggggtggtggttggcggggtggtggttggtggggtggtggctgayggggtggtggctggcaggccgagcctagatggcagccagagccccaggcatgtgtctgggcacaggacggtgttgcctagtttgaacaccctctttgctc

SEQ ID NO: 82332 - DNA, 201 bp, Homo sapiens
tgcgtttccagacagttacagcattctgcgtcacaggatgagataggagatacaggtcataaagaccttgctgataaaatagtttgcagtaggccaggcgmggtagctcacgcctgtaatcccagcactttgggaggctgaggtgggcggatcacctgaggtcagaagttcgagaccagcctggccaacaaggtgaaacct

SEQ ID NO: 82333 - DNA, 201 bp, Homo sapiens
gcgtttccagacagttacagcattctgcgtcacaggatgagataggagatacaggtcataaagaccttgctgataaaatagtttgcagtaggccaggcgcrgtagctcacgcctgtaatcccagcactttgggaggctgaggtgggcggatcacctgaggtcagaagttcgagaccagcctggccaacaaggtgaaacctc

SEQ ID NO: 82334 - DNA, 201 bp, Homo sapiens; identical to SEQ ID NO: 11794

SEQ ID NO: 82335 - DNA, 201 bp, Homo sapiens
ttccagacagttacagcattctgcgtcacaggatgagataggagatacaggtcataaagaccttgctgataaaatagtttgcagtaggccaggcgcggtasctcacgcctgtaatcccagcactttgggaggctgaggtgggcggatcacctgaggtcagaagttcgagaccagcctggccaacaaggtgaaacctcatct

SEQ ID NO: 82336 - DNA, 201 bp, Homo sapiens; identical to SEQ ID NO: 61300

SEQ ID NO: 82337 - DNA, 201 bp, Homo sapiens
tccagacagttacagcattctgcgtcacaggatgagataggagatacaggtcataaagaccttgctgataaaatagtttgcagtaggccaggcgcggtagstcacgcctgtaatcccagcactttgggaggctgaggtgggcggatcacctgaggtcagaagttcgagaccagcctggccaacaaggtgaaacctcatctc

SEQ ID NO: 82338 - DNA, 201 bp, Homo sapiens
agaccagcctggccaacaaggtgaaacctcatctctactaaaaatacaaaaactagccaggcatggtggtgtgtgcctgtaatcccagctacttgggaggytgaggcaggagaatcgcttgaacccaggaggtggaggttgcagtgagctgagatcgtgtcactgcactccagcctggagcgagactccgtctcaaaaaac

SEQ ID NO: 82339 - DNA, 201 bp, Homo sapiens
ccaggcatggtggtgtgtgcctgtaatcccagctacttgggaggctgaggcaggagaatcgcttgaacccaggaggtggaggttgcagtgagctgagatcrtgtcactgcactccagcctggagcgagactccgtctcaaaaaacaaaacaaacaaaaaaatcagcttgcaatatagaagctggctaaaacccacccaaac

SEQ ID NO: 82340 - DNA, 201 bp, Homo sapiens
tgtggaggctgggggggattcgattagcctggtttttgtgactcaaatcctgggaaggggctgccaagtcccaacttccagttatcctggctctatttagmcacagcctgtgggcatgtgggcagagctcaccctctgtctacccaacccctggtgtgtgactggggtgccagacaccttctctgtctccagcagggtgtc

SEQ ID NO: 82341 - DNA, 201 bp, Homo sapiens
aaaaatcagcttgcaatatagaagctggctaaaacccacccaaaccaagatggtgatgagagtgacctctggtcgtccccactgctacactcccaccagcrccatgacaggttacagatgccatggcagtatcaggaagttaccatatatggtctaaaaaggggagacatgaacaatccacccctgtttagcagatcatcc

SEQ ID NO: 82342 - DNA, 201 bp, Homo sapiens
aaaatcagcttgcaatatagaagctggctaaaacccacccaaaccaagatggtgatgagagtgacctctggtcgtccccactgctacactcccaccagcaycatgacaggttacagatgccatggcagtatcaggaagttaccatatatggtctaaaaaggggagacatgaacaatccacccctgtttagcagatcatcca

SEQ ID NO: 82343 - DNA, 201 bp, Homo sapiens
gtttagcagatcatccagaaacaaccataaaaatgggcaaccagcagccctcagggctgcgctctctatggagtagccattcttttattcttttactttcytaataaatgtgctttcactttatggactcgtctcaaattctttcttgcacgagatccaagaaccctctcctggggtctgaatctggacccctttccggta

SEQ ID NO: 82344 - DNA, 201 bp, Homo sapiens
ccataaaaatgggcaaccagcagccctcagggctgcgctctctatggagtagccattcttttattcttttactttcctaataaatgtgctttcactttatrgactcgtctcaaattctttcttgcacgagatccaagaaccctctcctggggtctgaatctggacccctttccggtaacagatgtcgtagagtgaagcaca

SEQ ID NO: 82345 - DNA, 201 bp, Homo sapiens; identical to SEQ ID NO: 61307

SEQ ID NO: 82346 - DNA, 201 bp, Homo sapiens
acaccgcatctacagaaaaattttaaaattagctgggcgtggtggtgtgtacctgtaggcctagctgctcaggaggctgaagcaggaggatcacttgagcytgagttcaacactgcagtgagctatggtggcaccactgcactccagcctgggtgacagagcaagaccctgtctctaaaataaattttaaaaagacatatt

SEQ ID NO: 82347 - DNA, 201 bp, Homo sapiens; identical to SEQ ID NO: 61309

SEQ ID NO: 82348 - DNA, 201 bp, Homo sapiens
gggcacaggacggtgttgcctagtttgaacaccctctttgctctgtcactcctgcttcccttgggcgttcacattctcccattgcttcatgcaagagctgmtgagtggcctatatcagccagctgttgccgcataacaaaaccatcccaaaactgagtgcagggaggcaacttcacctcgggctccactccacaagcccaa

SEQ ID NO: 82349 - DNA, 201 bp, Homo sapiens
tccacaggggccctgaacctcccagcccttttgtctctccctacattacagcttctagttttgctggggtccccagaaccaccaagtcactactcctatargcccctgcctcccctgcccctcaagtgggcagaagaaggcactggggtttggacatctggatctcgtgagcccgcacacatggaagtcatttcagctttc

SEQ ID NO: 82350 - DNA, 201 bp, Homo sapiens
ggtgttgcctagtttgaacaccctctttgctctgtcactcctgcttcccttgggcgttcacattctcccattgcttcatgcaagagctgctgagtggcctrtatcagccagctgttgccgcataacaaaaccatcccaaaactgagtgcagggaggcaacttcacctcgggctccactccacaagcccaaggggccaggtg

SEQ ID NO: 82351 - DNA, 201 bp, Homo sapiens; identical to SEQ ID NO: 61311

SEQ ID NO: 82352 - DNA, 201 bp, Homo sapiens
ctcattcaagcaaagctatcttcagcagggacttctccctctaggcagcaagcgcatttttattttacctgtcctcaaactgatcctttgctccttataayagtaaggaacacacccctgtgtggagatttaagatgctaatgaggccaagcgcagttgctcacgtctgtaattccagcactttgggaggcagaggtgggc

SEQ ID NO: 82353 - DNA, 201 bp, Homo sapiens
gggtggagacttaatgagggcggggagttgctgcagcaaaggctcctcccaggggtatcagcgcagacagctgggttttcactgtgctcctgctccagagvcactaggaagggggcgcctatcagactagggctctgccagccatccttctctgttgaaggtccagcatggtccgctgcctggggcctgcgctgctgctgc

SEQ ID NO: 82354 - DNA, 201 bp, Homo sapiens
tgcagcaaaggctcctcccaggggtatcagcgcagacagctgggttttcactgtgctcctgctccagaggcactaggaagggggcgcctatcagactaggrctctgccagccatccttctctgttgaaggtccagcatggtccgctgcctggggcctgcgctgctgctgctgctgttactgggtgagcgcccctctcttcc

SEQ ID NO: 82355 - DNA, 201 bp, Homo sapiens
agccggagggacgggggctgctggaggcccaggaaaactttggaagagggagcagtttgccaaaattggaagtggaggagtcaaatttgaattctataggraatgagcagcagctcatttggaaacaagcctcaggtagcagaggctctgaggaggccctgaccatggctacccgatgcccccataatgtcctcagcaccc

SEQ ID NO: 82356 - DNA, 201 bp, Homo sapiens
acccaggggcaaggagagcagacatagctgccgaaggggcggacatccaaggttctttggaagctgagcgatgccagcatctggagagtgccaggctgctsggtggtgtcagagcctggaggaaatgttaggactagagagaggaggtgccagccgagggcatgaggctcacttggagcctggatcccaaggctcccctga

SEQ ID NO: 82357 - DNA, 201 bp, Homo sapiens
cccagccctcctacccatcacacagattccttggtgaatcttcggtgttgttcatctgttgttccaccttcttggactgctccgtccctgcatggatgtcrcggagggaggggtcactttaccgagtgtagtgtggaaagtggaatctggtaaaggtttaaggtggaggagatcttgcagctgagatgagctgctgtgagg

SEQ ID NO: 82358 - DNA, 201 bp, Homo sapiens
acaggcagaggtgggttcaaacccttaggcaacatcaggtgctggtgtgtgcagctgagacctgaggatgtgcctggcaaggctgtgagaggaaagcaaaktgtgccctttggggaggggaggaagggaggactcaccccgctgccatctatcccctccactcagggaccattctaagccctcgagctatgttcatccttc

SEQ ID NO: 82359 - DNA, 201 bp, Homo sapiens
aggtgcagagagcagccccagaggccatggaaagaagtagctttgaacaggaggttccagtggcctcccagtcaagcgtgggggtggatccctgccccacsaccagcaccgcaaggcatggccctctacctcccagtacagctcctcttgtccactctcctgcttctcccaccagctggctgcctcacccttgacttcgcc

SEQ ID NO: 82360 - DNA, 201 bp, Homo sapiens
gcacgtccactcaggctgggcaccagaaaggcttctagtctgaatgagatgctccagactggagaacttgtggaggctgggggggattcgattagcctggkttttgtgactcaaatcctgggaaggggctgccaagtcccaacttccagttatcctggctctatttagacacagcctgtgggcatgtgggcagagctcacc

SEQ ID NO: 82361 - DNA, 201 bp, Homo sapiens
acttccagttatcctggctctatttagacacagcctgtgggcatgtgggcagagctcaccctctgtctacccaacccctggtgtgtgactggggtgccagrcaccttctctgtctccagcagggtgtcacctatcatggggcctggtcactaaaaccactgatgaacccttgggtcctgtggctcaggacaaagcccggcg

SEQ ID NO: 82362 - DNA, 201 bp, Homo sapiens
ttgctccttataatagtaaggaacacacccctgtgtggagatttaagatgctaatgaggccaagcgcagttgctcacgtctgtaattccagcactttgggwggcagaggtgggcgggtcacttgaggttagaagttcgagaccagcctggccaacatggtgaaaccttgtctctactaaaaatacaaaaattagccgggca

SEQ ID NO: 82363 - DNA, 201 bp, Homo sapiens
gtggaggagaaaaaaggagttggggtggcctagcaggagctgagtcacttccacaggcagccatcagcccagcaggactgaggccagggctgcgtggaggsgggaggctgtctgttctgggagctgggactgggtaccgggggaaggagggctgctgcaggctctgggtgcctggggcctggctcctgcagggcgggcctg

SEQ ID NO: 82364 - DNA, 201 bp, Homo sapiens
ggcagaagaatcgcttgaacctgggaggcggaggttgcagtgagccaagatcgtgccactgcactccagcctgagggagagagagagcaagacatcgtttttgtttgtttgtttgtttgtttgtttgttttttaaaaaaaagtcaagacaaatcatagtgggggcttttctggtcactttttaaatcttagtgttgagact

SEQ ID NO: 82365 - DNA, 201 bp, Homo sapiens
gctcacaactgctcgctgcgcccgggggcccagtgcgcccacggggactgctgcgtgcgctgcctggtgagggcatggaaggttcagggtgagggtttcgkggagcttgggagccggcctgttggccttagttaattggtgccctcaggttcccccgttgggtgctgggcttgggtaggcctggctcccccagctccgagc

SEQ ID NO: 82366 - DNA, 201 bp, Homo sapiens
gcagaagaatcgcttgaacctgggaggcggaggttgcagtgagccaagatcgtgccactgcactccagcctgagggagagagagagcaagacatcgtttttgtttgtttgtttgtttgtttgtttgttttttaaaaaaaagtcaagacaaatcatagtgggggcttttctggtcactttttaaatcttagtgttgagactt

SEQ ID NO: 82367 - DNA, 201 bp, Homo sapiens
cagaagaatcgcttgaacctgggaggcggaggttgcagtgagccaagatcgtgccactgcactccagcctgagggagagagagagcaagacatcgtttttgtttgtttgtttgtttgtttgtttgttttttaaaaaaaagtcaagacaaatcatagtgggggcttttctggtcactttttaaatcttagtgttgagacttt

SEQ ID NO: 82368 - DNA, 201 bp, Homo sapiens
cagccactccaggaacttgaactgcaggggcagagccagtgaatcaccggacctccagcacctgcaggcagcttggaagtttcttccccgagtggagcttygacccacccactccaggaacccagagccacattagaagttcctgagggctggagaacactgctgggcacactctccagctcaataaaccatcagtcccag

SEQ ID NO: 82369 - DNA, 201 bp, Homo sapiens
agaagaatcgcttgaacctgggaggcggaggttgcagtgagccaagatcgtgccactgcactccagcctgagggagagagagagcaagacatcgtttttgtttgtttgtttgtttgtttgtttgttttttaaaaaaaagtcaagacaaatcatagtgggggcttttctggtcactttttaaatcttagtgttgagacttta

SEQ ID NO: 82370 - DNA, 201 bp, Homo sapiens
ccccacctccctctttccctccctccctggatgatctgggccacccccacccccaccaggcagaaatgggtccagagtttgtgggtcctgaagcttttcargagcctctaaaaaaaaaaaaaaaaaagcaccaaaaagaaaaccttttgcaaagttgaccagaacatgtgaccctgtggacacactgctgtccctctcagg

SEQ ID NO: 82371 - DNA, 201 bp, Homo sapiens
gtcacccacttgaagttcccaaatgctgggcccagcacatcttttcactccataccactggtcagctgcggtgctggctgcccctgtgccagggccctgcyttaacccagttctctgtgacctgggtggtggcggagtggggagtcacataatactaagcatggctgtcctaggactcaccctgcaccagggccctaggca

SEQ ID NO: 82372 - DNA, 201 bp, Homo sapiens
aggtgctggtgtgtgcagctgagacctgaggatgtgcctggcaaggctgtgagaggaaagcaaagtgtgccctttggggaggggaggaagggaggactcaycccgctgccatctatcccctccactcagggaccattctaagccctcgagctatgttcatccttcctgcagaggcaggtgctgaagtcacagcaggaatca

SEQ ID NO: 82373 - DNA, 201 bp, Homo sapiens
tccctcagtttcctcttctgtaaaatggggataatgatcatagtgtccgcttcagggtggtttatgaggcttaaagggaagaagctcaggcaaagtggatyctcaacggtatgaagattattttccgagtaacctggcgaggttactcctacaccgggaggagcaccgtcgggtcgcgattccaccttgggtcccgggctg

SEQ ID NO: 82374 - DNA, 201 bp, Homo sapiens; identical to SEQ ID NO: 61342

SEQ ID NO: 82375 - DNA, 201 bp, Homo sapiens; identical to SEQ ID NO: 61343

SEQ ID NO: 82376 - DNA, 201 bp, Homo sapiens; identical to SEQ ID NO: 61344

SEQ ID NO: 82377 - DNA, 201 bp, Homo sapiens; identical to SEQ ID NO: 61345

SEQ ID NO: 82378 - DNA, 201 bp, Homo sapiens
tctgcactggcggccttggcctcttccttgtgatcgccgagcccaagcctgccccccgacaaaggtcaggggactcccgtgtccccagctgagctgtcccyttccagccttctcttttcctcctccttgatagctcctcagatccaaggatgcccacgggcgtccctccttctccaggctgagcccacgcgtgttgaaggt

SEQ ID NO: 82379 - DNA, 201 bp, Homo sapiens
agatcacagaaggccattttggtgctcagtgtcctggaccatccagagccaaagattttgagctggggaagggacaggcagacctgtgctcaggaaggtgmcttgggctgggtggggtgggtgtccgggctggagcgcaggctcttaaaaccacccagattatgttatcagtatatatcacctactgagtgcttgaccgca

SEQ ID NO: 82380 - DNA, 201 bp, Homo sapiens
gagccagtgaatcaccggacctccagcacctgcaggcagcttggaagtttcttccccgagtggagcttcgacccacccactccaggaacccagagccacaytagaagttcctgagggctggagaacactgctgggcacactctccagctcaataaaccatcagtcccagaagcaaaggtcacacagcccctgacctccctc

SEQ ID NO: 82381 - DNA, 201 bp, Homo sapiens
catgcaatttccacggacccagctctgtggagggcatgactgctggccagaagctagtggtcctggggccctatggttcgactgagtccacactcccctgsagcctggctggcctctgcaaacaaacataattttggggaccttccttcctgtttcttcccaccctgtcttctcccctaggtggttcctgagcccccaccc

SEQ ID NO: 82382 - DNA, 201 bp, Homo sapiens
gctctgtggagggcatgactgctggccagaagctagtggtcctggggccctatggttcgactgagtccacactcccctggagcctggctggcctctgcaarcaaacataattttggggaccttccttcctgtttcttcccaccctgtcttctcccctaggtggttcctgagcccccacccccaatcccagtgctacacctg

SEQ ID NO: 82383 - DNA, 201 bp, Homo sapiens
aaggaaaagaaaaatgctgtttcatagcgttcctagtttagcatgggagagaccaggtctccctgggtggttgtctgtgtgttgctgggtgtgcgtggcarggctagtgtgttggggtccgtctaggcacattcaggcgccgaatcccgtggctcccaggtttacctgacggtgcagcctggggtggagacttaatgaggg

SEQ ID NO: 82384 - DNA, 201 bp, Homo sapiens
tggcgctgaccggcctggaggtgtggaccgagcgggaccgcagccgcgtcacgcaggacgccaacgccacgctctgggccttcctgcagtggcgccggggrctgtgggcgcagcggccccacgactccgcgcagctgctcacgtgggtgcctctgacccggacgcgggtcccgggtggggcggcctcacctcccggccccg

SEQ ID NO: 82385 - DNA, 201 bp, Homo sapiens; identical to SEQ ID NO: 61349

SEQ ID NO: 82386 - DNA, 201 bp, Homo sapiens
accccgaaccctggcctctctgtccctgctcctcagtgacaaggtgggagggcaagatattccaggaaaagctgaaccacaggaagggttgccagtgagargcctgtgcgcacggcttggggacccctggcaattgaccccactatgtgctgagcacctcacctcccagccccgtcaagccaccaccgccatccccctccc

SEQ ID NO: 82387 - DNA, 201 bp, Homo sapiens; identical to SEQ ID NO: 61353

SEQ ID NO: 82388 - DNA, 201 bp, Homo sapiens; identical to SEQ ID NO: 61354

SEQ ID NO: 82389 - DNA, 201 bp, Homo sapiens
ccacaccaaacagcgtctcctggaagtcgccaactacgtggaccaggttgggggcggcggggagagagcggtgatgggggtggcggcggcaggacaggcargtgctggtggggtttggggaagaggaagggcgccccacgaaggaccaccggcgcgatggggcgccctgtcccggcttcagccccgcctcgccctcagctt

SEQ ID NO: 82390 - DNA, 201 bp, Homo sapiens
ccagttatcctggctctatttagacacagcctgtgggcatgtgggcagagctcaccctctgtctacccaacccctggtgtgtgactggggtgccagacacyttctctgtctccagcagggtgtcacctatcatggggcctggtcactaaaaccactgatgaacccttgggtcctgtggctcaggacaaagcccggcggtgt

SEQ ID NO: 82391 - DNA, 201 bp, Homo sapiens; identical to SEQ ID NO: 61362

SEQ ID NO: 82392 - DNA, 201 bp, Homo sapiens
cagccacgaccccgacggctgctgcgtggaggctgcggccgagtccggaggctgcgtcatggctgcggccaccgggtacgcgggtggggggtcggggctgmggcggggcggctagtcctggggacttcctccgctgcgtttctttggtcgtccctcagtttcctcttctgtaaaatggggataatgatcatagtgtccgct

SEQ ID NO: 82393 - DNA, 201 bp, Homo sapiens
ttttgatgccccttctgggcatgaaagaagagggcgggccaggggaggggcacctttctgggacctctggtctctagggaggatgctggtgtgcctggcargctgtgccaacgcccttccaagtggctgttgtcaggactgcaaacatcctgagtttgggaacatctttgtatgttctcacctcctccacgccctccatag

SEQ ID NO: 82394 - DNA, 201 bp, Homo sapiens; identical to SEQ ID NO: 61370

SEQ ID NO: 82395 - DNA, 201 bp, Homo sapiens
gtgttgaaggtgaagtctgccccaaaaggcctccagtgcctccctggggatgtcctctacccccctccctctgctttgtcccatgcccctgtgttcctcargtccccctcaccctgtgctctgtctttactccaggacatatccctgggcagccagtcaccccgcactgggtcctggatggacaaccctggcgcaccgtca

SEQ ID NO: 82396 - DNA, 201 bp, Homo sapiens
caggtgctgaagtcacagcaggaatcactctcaccacgcggtccaatccacagcctgaaagacacagccattgccagagaggcaccctgctcccagccctggggggggataccaccccgtagcccctgtgcacaaacacacagggagatggatgaggggccaggctgtgcacgtccactcaggctgggcaccagaaaggct

SEQ ID NO: 82397 - DNA, 201 bp, Homo sapiens
tctgagccctatcctggggtcaggggaggtgatgggacccctgggagaggggcgtctatgtgcccaataccagcctggctccctcgggttccacccccatycacccggtcaccggagctccagctccagctccagctctgcccctctctccctcattggggtcagggtgcccgtggccagcacgtgcgcgcaaggccatgt

SEQ ID NO: 82398 - DNA, 201 bp, Homo sapiens
ccccaggaacttttgcctattgtctgccatctcccaactctctcaccctcccctcagccccagccctcctacccatcacacagattccttggtgaatcttyggtgttgttcatctgttgttccaccttcttggactgctccgtccctgcatggatgtcgcggagggaggggtcactttaccgagtgtagtgtggaaagtgg

SEQ ID NO: 82399 - DNA, 201 bp, Homo sapiens
gacaggaattcacaggcctcgagtcccagtatttttattgaagtctgaagaaacaagttccagaaaacatgttaaacttccttctgggagctgggattggkggtcagggctcaagcccagcagcttccactcagggtccccatttgcacctccgcagggcaggcgagaagcgcgcaggacccggaagtacctggaactgta

SEQ ID NO: 82400 - DNA, 201 bp, Homo sapiens; identical to SEQ ID NO: 11816

SEQ ID NO: 82401 - DNA, 201 bp, Homo sapiens; identical to SEQ ID NO: 11824

SEQ ID NO: 82402 - DNA, 201 bp, Homo sapiens; identical to SEQ ID NO: 61382

SEQ ID NO: 82403 - DNA, 201 bp, Homo sapiens; identical to SEQ ID NO: 61383

SEQ ID NO: 82404 - DNA, 201 bp, Homo sapiens; identical to SEQ ID NO: 61384

SEQ ID NO: 82405 - DNA, 201 bp, Homo sapiens; identical to SEQ ID NO: 61385

SEQ ID NO: 82406 - DNA, 201 bp, Homo sapiens
agagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtggtga

SEQ ID NO: 82407 - DNA, 201 bp, Homo sapiens
atttaagcttgagattttgatgtttggaaatttttacaatttgtttgatggttagaaaagataaacattgttgaaaagattgtaactgaaatgcatgtgtstatttgcatgtgaattaatgatagagcaaacacattaataaatatcattgaacagaggctaggaggaaaacatcttctcagccattggtagtagtaacaa

SEQ ID NO: 82408 - DNA, 201 bp, Homo sapiens
ctttgattgactccgttattccgaaaggggcacaggcatgccaaatttgcatcacatacatttgtgaagaagacagttacctggcagggacgctgggactytcagcaggtaagggtcagtgacttacactcaagttcacctagggcctgtcttcgtgcctaacatttgatttctttactagtcatgttaattggaagaaaa

SEQ ID NO: 82409 - DNA, 201 bp, Homo sapiens
gatgtttctgttttcatctatgtgtaataaacacgtatttttctaccaatgcctctttcattttctacctcccaccactctctaaattaaagaacatcttkaacattatttaatgtcagtcagtcagtcagtgttatgggagaaatttttagtggggagtgttttacagattggggtaaagttttccagagatgataagtg

SEQ ID NO: 82410 - DNA, 201 bp, Homo sapiens
ttttctcaaatttggaaccatctctctatttctacttctattattttattaaagaacccctattcccatagtgcactcttaaacttatatctgaaagcaawgtagaggctaggaatgcaaattatttatcaagttcagatattactctactgaatttattaaggttgggtatcatgaatattttcttaaatgtttcacagc

SEQ ID NO: 82411 - DNA, 201 bp, Homo sapiens
ttgattacatgagaggaatatgaggctgttttcatgatgtgagaaatccttgtgctctaaacagacaaggtcctgaaggagaagagaaagctgtttatccrttccatgggtgaaggtacaataaatggcttactggatgaattattacagacaagggtgctgaacaaggaagagatggagaaagtaaaacgtgaaaatgct

SEQ ID NO: 82412 - DNA, 201 bp, Homo sapiens
agtttttttctattgttttcacacttctttatgaagaaatccaacattttatccaacaaatgattattctataattttttccaatatatctattctaattmgttcttctccacatcagcacatttcatgctgcctttgtttatctaactgattgtataacaatttttcaaatttgtttttaaaattaaatattattttttg

SEQ ID NO: 82413 - DNA, 201 bp, Homo sapiens
tgattattctataattttttccaatatatctattctaattcgttcttctccacatcagcacatttcatgctgcctttgtttatctaactgattgtataacmatttttcaaatttgtttttaaaattaaatattattttttgccttaatagcttctaaaagatcctccacacatctagaaaacttatttctattttaaaaca

SEQ ID NO: 82414 - DNA, 201 bp, Homo sapiens
tccttttactagaacaagtctcagttaaaggcttcatttagctgagatagctgggtttctaaatagaattttattattaatatatactttatgacctttakaactggctaaaatgtgtcattaaagaatgtgtctgtcattacatacagagctattgctgctgcttttctcttatgacttcctttgcataattttatgcct

SEQ ID NO: 82415 - DNA, 201 bp, Homo sapiens
gcacaggcatgccaaatttgcatcacatacatttgtgaagaagacagttacctggcagggacgctgggactctcagcaggtaagggtcagtgacttacacycaagttcacctagggcctgtcttcgtgcctaacatttgatttctttactagtcatgttaattggaagaaaactttcttatttctggcttcagggccatat

SEQ ID NO: 82416 - DNA, 201 bp, Homo sapiens
agtcggcagaggtgccatgctcagaacccaaggatagagtggggtgaaagaaacacttcaggcagttctgaaatgcagtggcttattcttagagccaaccycattgagcagttctggagaatcatacttctgctccccttacataaaggatttctatatcctagaatcccaggtttatagaaagaggtccaaattggatcc

SEQ ID NO: 82417 - DNA, 201 bp, Homo sapiens
attcctagaagaactggagctgaggttgacatcacaggcatgacaatgctgctacaaaatctggggtacagcgtagatgtgaaaaaaaatctcactgcttyggtaagttctattatacaacagaaacaatggttatgcccttcgtataactgaataatattagaaagcttggttgtaagaccaagaaatgtaatctcttga

SEQ ID NO: 82418 - DNA, 201 bp, Homo sapiens
aatgcctttcttctggtcagtgcagagcacgttgctcttctcccaaagtttttcatttagaccccttttgagattcatctgatattggcctagaagtggcygtaagactacaaaccctcacttttggatgtttctctccttcacctcagcagggtatatttaaacatagcatgtggtctttccttttaaaattgtgtatgt

SEQ ID NO: 82419 - DNA, 201 bp, Homo sapiens
caaaatatttacctgtggatttatttttgctgagtgcaaggggtctgtaggcacttatggagttgtaaagtcacatgaagctttaaggtttataatcaaayactttttataacttttctccaaaattttaccctcccaaaagaataaaatatatttcaatgatggcgatacactcagagaacacattgaacgtatagaaaa

SEQ ID NO: 82420 - DNA, 201 bp, Homo sapiens
tattatacaacagaaacaatggttatgcccttcgtataactgaataatattagaaagcttggttgtaagaccaagaaatgtaatctcttgataatctaaartacaaacttgccatgagagagtgctggatactacatggtcctttgtaacataagagtcatgcagcacaagcctggtataactgaattgggaaatgtttta

SEQ ID NO: 82421 - DNA, 201 bp, Homo sapiens
agctcagctgccatctgggcatttgcaatgtccatgcatactcttgaagcagcattcaattctgttcccccttttcaatgtatggttcatggggtttggtrtcttgataggactaaggaaggggaagctgtcataaaccaggaagggaaatatttaattggaaagaacaaggctgttcattcaaattgcatttcctacaga

SEQ ID NO: 82422 - DNA, 201 bp, Homo sapiens
ccacaccaggtaacaggtttctacacaggacatctttgttggggctatcaatagaaaaagtgacaataacccactagaggtggtgattaacaactcaagaycaactcaagctttgttccaagttatacacagaattccctttatccaagagagcaattttgcatatctgttcaatgcattactaattaaagaattcatcta

SEQ ID NO: 82423 - DNA, 201 bp, Homo sapiens
tttccagacagccctggtgtggtgtggtttaaagattcagtaggagtttctggaaacctatctttaccaactacagaagagtttgaggatgatgctattargaaagcccacatagagaaggattttatcgctttctgctcttccacaccaggtaacaggtttctacacaggacatctttgttggggctatcaatagaaaaa

SEQ ID NO: 82424 - DNA, 201 bp, Homo sapiens
caactcaatgcaatctttaacatgttgaataccaagaactgcccaagtttgaaggacaaaccgaaggtgatcatcatccaggcctgccgtggtggtgagtrctgatgcctttgagaacaccagacaatcaaatactatcctactctgtatgcatccaagaatttttggtttcttttggtttgtcttttaatgtcaaagaac

SEQ ID NO: 82425 - DNA, 201 bp, Homo sapiens
caataaatggcttactggatgaattattacagacaagggtgctgaacaaggaagagatggagaaagtaaaacgtgaaaatgctacagttatggataagacycgagctttgattgactccgttattccgaaaggggcacaggcatgccaaatttgcatcacatacatttgtgaagaagacagttacctggcagggacgctgg

SEQ ID NO: 82426 - DNA, 201 bp, Homo sapiens
tgaaaagcttcatgctgtgttttccagtgttcctggcaaggcaaaatatttacctgtggatttatttttgctgagtgcaaggggtctgtaggcacttatgkagttgtaaagtcacatgaagctttaaggtttataatcaaatactttttataacttttctccaaaattttaccctcccaaaagaataaaatatatttcaat

SEQ ID NO: 82427 - DNA, 201 bp, Homo sapiens
gttgcctccttgtattttctttgagtaagatcacctggttgcctgttaccaggctgtgggtcatgctgtgaggcctggaaatcctccacttgcaaccctcytcaggcccaatacagggctcaggaactgagctggccaaatctcatgaccacttggacctaccacgtggtgaggatgagagttctggtggattcccagtca

SEQ ID NO: 82428 - DNA, 201 bp, Homo sapiens
ggacattaaaataaggaaactgtatgaatgtctgtgggcaggtacatgtgtatggtcgggagtgtgggaaggttgaggaaagggtactgaaagtccatttkagtcaagaactctaggtttacaggctgagaatccttaatccaaaaatttgaattttgaaatgctctaaaatccaacactgtgtgagcgcccacatgatat

SEQ ID NO: 82429 - DNA, 201 bp, Homo sapiens
aggaaactgtatgaatgtctgtgggcaggtacatgtgtatggtcgggagtgtgggaaggttgaggaaagggtactgaaagtccatttgagtcaagaactcyaggtttacaggctgagaatccttaatccaaaaatttgaattttgaaatgctctaaaatccaacactgtgtgagcgcccacatgatattcaaaggaaatgt

SEQ ID NO: 82430 - DNA, 201 bp, Homo sapiens
ctctcaaggagtactttcttcctttccaggtaatgctgtttttaaaggaagagcattctttgacccacatcttccttgacattaattttgtaggatcaaaygtgggtaaatgggctatggagaattctcatagattggtcatataattttctttttgtaatctattctgcttttgtagaaactgtttccacagcttcatta

SEQ ID NO: 82431 - DNA, 201 bp, Homo sapiens
aatttgtttttaaaattaaatattattttttgccttaatagcttctaaaagatcctccacacatctagaaaacttatttctattttaaaacaaaggttacrttaatttctttaacaaggacatcacattgttggattgtgttgaacctgtgatgaaataaaaggctcaaggattttctcacataaactctgtgaaaacatt

SEQ ID NO: 82432 - DNA, 201 bp, Homo sapiens
ctacaaaatctggggtacagcgtagatgtgaaaaaaaatctcactgcttcggtaagttctattatacaacagaaacaatggttatgcccttcgtataactraataatattagaaagcttggttgtaagaccaagaaatgtaatctcttgataatctaaaatacaaacttgccatgagagagtgctggatactacatggtcc

SEQ ID NO: 82433 - DNA, 201 bp, Homo sapiens
aaggggcacaggcatgccaaatttgcatcacatacatttgtgaagaagacagttacctggcagggacgctgggactctcagcaggtaagggtcagtgactyacactcaagttcacctagggcctgtcttcgtgcctaacatttgatttctttactagtcatgttaattggaagaaaactttcttatttctggcttcagggc

SEQ ID NO: 82434 - DNA, 201 bp, Homo sapiens
taacttaattcagttacttttctaagcaaggtttaaataaaaattatttaaatcctttcattcaccacctttggcagtttcctgagaggacttgcattctyttggtcacctctggcccaaaggccctgtctctgctcaaatagttaagttttctaaaatattttctaaaatgagatatcttctttcagaagaagcttggtt

SEQ ID NO: 82435 - DNA, 201 bp, Homo sapiens
gggggacatttcactgatgaaatctaaatgaggtcactttctgttgattacatgagaggaatatgaggctgttttcatgatgtgagaaatccttgtgctcyaaacagacaaggtcctgaaggagaagagaaagctgtttatccgttccatgggtgaaggtacaataaatggcttactggatgaattattacagacaagggt

SEQ ID NO: 82436 - DNA, 201 bp, Homo sapiens
aggtttaaataaaaattatttaaatcctttcattcaccacctttggcagtttcctgagaggacttgcattctcttggtcacctctggcccaaaggccctgyctctgctcaaatagttaagttttctaaaatattttctaaaatgagatatcttctttcagaagaagcttggttctacattgggttgaacatgccctgatgt

SEQ ID NO: 82437 - DNA, 201 bp, Homo sapiens
gaggatgatgctattaagaaagcccacatagagaaggattttatcgctttctgctcttccacaccaggtaacaggtttctacacaggacatctttgttggkgctatcaatagaaaaagtgacaataacccactagaggtggtgattaacaactcaagaccaactcaagctttgttccaagttatacacagaattcccttta

SEQ ID NO: 82438 - DNA, 201 bp, Homo sapiens
aatggtaaactcagtcttcaggtcactccatgcacatgtatggagactattgagggaaacaagtaggacagcaatacagtaagaagagggattacccaacygtgaggagggggacatttcactgatgaaatctaaatgaggtcactttctgttgattacatgagaggaatatgaggctgttttcatgatgtgagaaatcct

SEQ ID NO: 82439 - DNA, 201 bp, Homo sapiens
aacctatctccacattctgctgtgccaatcccaaccacatcatagtgatctcctgaagaaaaataattatctacttccttaatttcacaaaacatttgcaragatatctgtctccacgatatctttcacttacttccttttactagaacaagtctcagttaaaggcttcatttagctgagatagctgggtttctaaataga

SEQ ID NO: 82440 - DNA, 201 bp, Homo sapiens
attccaatatacaaaaatatctgaaatttgaaatacttctggtagcatgcattttggataagggataatcaagccatatacagaaaatactgaagtaatgyctttcttctggtcagtgcagagcacgttgctcttctcccaaagtttttcatttagaccccttttgagattcatctgatattggcctagaagtggccgtaa

SEQ ID NO: 82441 - DNA, 201 bp, Homo sapiens
caggtccctgggaagaaagagttttggaaggggctggctcttctggaagccataattagcatctgtggaagtttacttgagtagaagcaaggaaaaggggrgagagggaggagagaaggaactagaagattcttgcagactttagaaaggaaaggcaagcccagaaaggaactgaggctttaggggaagcctgatgtcatt

SEQ ID NO: 82442 - DNA, 201 bp, Homo sapiens
ctccacgatatctttcacttacttccttttactagaacaagtctcagttaaaggcttcatttagctgagatagctgggtttctaaatagaattttattatyaatatatactttatgacctttagaactggctaaaatgtgtcattaaagaatgtgtctgtcattacatacagagctattgctgctgcttttctcttatgac

SEQ ID NO: 82443 - DNA, 201 bp, Homo sapiens
caaggtcctgaaggagaagagaaagctgtttatccgttccatgggtgaaggtacaataaatggcttactggatgaattattacagacaagggtgctgaacmaggaagagatggagaaagtaaaacgtgaaaatgctacagttatggataagacccgagctttgattgactccgttattccgaaaggggcacaggcatgcca

SEQ ID NO: 82444 - DNA, 201 bp, Homo sapiens
gctgtttatccgttccatgggtgaaggtacaataaatggcttactggatgaattattacagacaagggtgctgaacaaggaagagatggagaaagtaaaaygtgaaaatgctacagttatggataagacccgagctttgattgactccgttattccgaaaggggcacaggcatgccaaatttgcatcacatacatttgtga

SEQ ID NO: 82445 - DNA, 201 bp, Homo sapiens
tacttccttttactagaacaagtctcagttaaaggcttcatttagctgagatagctgggtttctaaatagaattttattattaatatatactttatgaccwttagaactggctaaaatgtgtcattaaagaatgtgtctgtcattacatacagagctattgctgctgcttttctcttatgacttcctttgcataattttat

SEQ ID NO: 82446 - DNA, 201 bp, Homo sapiens
gagaggaatatgaggctgttttcatgatgtgagaaatccttgtgctctaaacagacaaggtcctgaaggagaagagaaagctgtttatccgttccatgggygaaggtacaataaatggcttactggatgaattattacagacaagggtgctgaacaaggaagagatggagaaagtaaaacgtgaaaatgctacagttatgg

SEQ ID NO: 82447 - DNA, 201 bp, Homo sapiens
cactttctgttgattacatgagaggaatatgaggctgttttcatgatgtgagaaatccttgtgctctaaacagacaaggtcctgaaggagaagagaaagcwgtttatccgttccatgggtgaaggtacaataaatggcttactggatgaattattacagacaagggtgctgaacaaggaagagatggagaaagtaaaacgt

SEQ ID NO: 82448 - DNA, 201 bp, Homo sapiens
attcaccacctttggcagtttcctgagaggacttgcattctcttggtcacctctggcccaaaggccctgtctctgctcaaatagttaagttttctaaaatrttttctaaaatgagatatcttctttcagaagaagcttggttctacattgggttgaacatgccctgatgtagaactcaataatttttttttcccaatgatc

SEQ ID NO: 82449 - DNA, 201 bp, Homo sapiens
gtatggtcgggagtgtgggaaggttgaggaaagggtactgaaagtccatttgagtcaagaactctaggtttacaggctgagaatccttaatccaaaaattygaattttgaaatgctctaaaatccaacactgtgtgagcgcccacatgatattcaaaggaaatgtttattgaaacatttcaaattataggtttttggatta

SEQ ID NO: 82450 - DNA, 201 bp, Homo sapiens
caatgatcagaaacaatgacactacccaaaaacaccatatattttcagcctgagtacgtatagcagagtttaatattagacagaactgttcgttagtatcstttgatcccagccttccacatgacattcaccgctctctaagtagctctttgtaggcctctggcttctcattatcaatctggctgatttatgtgtctttct

SEQ ID NO: 82451 - DNA, 201 bp, Homo sapiens
gaacagcaagcgagacactttggggccctaaattaaagtgggttttacctagaagcatgaagtgtgtgagacagaatatatttgaatttttctaaacgtaygctttggagtaagaatcttgctattattgactgacccagacatttagtattttgtaaaacagttccactagttcctcctcgggctttccttgaattgctg

SEQ ID NO: 82452 - DNA, 201 bp, Homo sapiens
ctttgctccctagaagaagctcaaaggatatggaaacaaaagtcggcagaggtgccatgctcagaacccaaggatagagtggggtgaaagaaacacttcargcagttctgaaatgcagtggcttattcttagagccaacctcattgagcagttctggagaatcatacttctgctccccttacataaaggatttctatatcc

SEQ ID NO: 82453 - DNA, 201 bp, Homo sapiens
tcccctgtatagctagctgagtctattaaatatcagaatgcataattaacttaaatcacagtcagtaataccactttgggaatgcacatttagatatttcrtttccaaatcccaatcactcccctctaccccattccgccttttccttatttgctactaaatttatgatttcaaacatccctcagctggagtataaatact

SEQ ID NO: 82454 - DNA, 201 bp, Homo sapiens
agcagaacagcaagcgagacactttggggccctaaattaaagtgggttttacctagaagcatgaagtgtgtgagacagaatatatttgaatttttctaaaygtatgctttggagtaagaatcttgctattattgactgacccagacatttagtattttgtaaaacagttccactagttcctcctcgggctttccttgaatt

SEQ ID NO: 82455 - DNA, 201 bp, Homo sapiens
acttccctgaatgcttggctattgcaattggaagcatagaaagcagatccagacaagtttatcttccaataatgctcttctttccaaaagagttttggagytctttggagagtggacaaacccaggagcctaatccaatctattaagacccacagccttgagaaaacaatcatttagtttcaccccgctcctgccctgcag

SEQ ID NO: 82456 - DNA, 201 bp, Homo sapiens
tgccatgttgagatcattcattagtccaatttgcccagacatcaaatatttataggagaagagtaagagcaagattctgaaaagcagaacagcaagcgagrcactttggggccctaaattaaagtgggttttacctagaagcatgaagtgtgtgagacagaatatatttgaatttttctaaacgtatgctttggagtaaga

SEQ ID NO: 82457 - DNA, 201 bp, Homo sapiens
atatcttactgtcaatgttatttaatttcgattaatcttttatgaagtacataaattgagaatttgataatataattaccccatgtagactgagtattgcmtatcctgggttatctcaaacacttgcgtgacctcagatacctcttgtgtatggagttattaccatcccctgtatagctagctgagtctattaaatatcag

SEQ ID NO: 82458 - DNA, 201 bp, Homo sapiens
tttcaatgatggcgatacactcagagaacacattgaacgtatagaaaagtgaagatttctaatgggctcattcctccagttgcctccttgtattttctttsagtaagatcacctggttgcctgttaccaggctgtgggtcatgctgtgaggcctggaaatcctccacttgcaaccctcctcaggcccaatacagggctcag

SEQ ID NO: 82459 - DNA, 201 bp, Homo sapiens
ctacagttatggataagacccgagctttgattgactccgttattccgaaaggggcacaggcatgccaaatttgcatcacatacatttgtgaagaagacagktacctggcagggacgctgggactctcagcaggtaagggtcagtgacttacactcaagttcacctagggcctgtcttcgtgcctaacatttgatttcttta

SEQ ID NO: 82460 - DNA, 201 bp, Homo sapiens
ggccacacctaggaaccggcttaaatgtccagaaactcctcaggtaccgctgggcttcccaaaccccctcaaaactaataacattttcactgctgtcaccmaacatatggagacagacatgcaaggggcagctggttttgggggtctctgtccattcatcagtgtctgtggggcctggaggagacggggaagctgtggggg

SEQ ID NO: 82461 - DNA, 201 bp, Homo sapiens
ggggccggggctacggggaccccgtgggaggagctggagaggtgcaggcccagggcgtcgtccgagtgagcagcggtgctggccgtgtgggacccgggccygcttagcaccatggacggggtgggctcacgaccctcgactgcggggcccgggcggcggcgctagcagatccagcggatgaagcggtcgaagaagccgggt

SEQ ID NO: 82462 - DNA, 201 bp, Homo sapiens
ttggcaatggattcttagagatcacatcaaaagcatgagcaaaagagagaaacagacaaattggacttcatcaaaagtaaaacaaaacaaaaaaacaaacytttgtgcttcaaaggacagtatcaaaaaaatgaaaagccaacccggagaatgggagaaaacatttgtaaattgtgcgtttgaaatgggactagtatgcag

SEQ ID NO: 82463 - DNA, 201 bp, Homo sapiens
ggctacagccgcgacgtgcacccggcgttcagcgagttcctcatcaacacctacggaatcctgaagcagcggcccgacctgcgcgccaaccccctgcacarcagcccggccgcgctgcgcaagctggtcatcgacgtggtgccccccaagttcctgggcgactcgctgctgctgctcaactgcctgtgcgagctctccaag

SEQ ID NO: 82464 - DNA, 201 bp, Homo sapiens
cactctagcctgggcaacagaacgacaccctgtctctaatgtaaacatatgtatataaaacataggaacaattttatgtttagaaatttaaaataaggtgmataattaaaaaacaagtaggaaaagtacatagatgaaaatgtaatcaagggacaggaaggaaacaagacgtgtggtttagagaaccatgagcggggacag

SEQ ID NO: 82465 - DNA, 201 bp, Homo sapiens
cgcgtgctcccctgcactctcctgtctgagctgagctgacctcagttgggtgctgcgagccagggcctcatgctggcctctcgccctccacagccccaggkgtccaggctcctccaggaacaaacgcaggccccacgggctgcctggaaggcctcccagaaggcagcacagggtcacgagggtcacccgcagtggcacagg

SEQ ID NO: 82466 - DNA, 201 bp, Homo sapiens
gtcagcgtggatgagtgtgtgctctgcgcccaggcctttggccagaggctggcagaggagctggacgtgccaggtgagcgtgcccccccgcccccctcacyctgctcccgtctcattggtgtgggttattggctccttctgtatcccccagttccctgcccttgactgctcttgcaagggcagagtgttccaaaaagccaa

SEQ ID NO: 82467 - DNA, 201 bp, Homo sapiens
catattccccactgagaaccccttggccagggctctggccacagtccgtgtgagtagggctcccagtgggtccttggaaggttggtgtgtggtcccagctrtgctcttccacacggggtgggtccgaggagccgagtgccttacggtgacgccgtgagctacacacatgagcacctaggaaaggccagtgcctgtgaccgg

SEQ ID NO: 82468 - DNA, 201 bp, Homo sapiens
cacctggcctcctgcccggcctcgccgtctctctgcaggagagcacccccgcatgggggccctagacgtctgccccttcatccccgtgaggggcgtcagcrtggatgagtgtgtgctctgcgcccaggcctttggccagaggctggcagaggagctggacgtgccaggtgagcgtgcccccccgcccccctcactctgctc

SEQ ID NO: 82469 - DNA, 201 bp, Homo sapiens
ggctgatggggcagcttgagtggctaaggcccaggccatggaggaggtggtgggcttggtgtcccgggtcgtcttcccaggatgggcagagccgctgcccrtgggccccaaggacatcccgtggctcagggccctggggagtgcctgacccaggggtgggtggaacacgactggtgcttgtgggggctgaggcttggctgt

SEQ ID NO: 82470 - DNA, 201 bp, Homo sapiens
cctggtccagtgtgactcgggtgagcttatcccaggataggctgatctctggtccagtgtctcgggtaagctcaccttagagcaggctgagcctggtccastgtgacttaggtgaggtattctagagcaggctgagccccagtccagtgtggtgacttgtatccttatccaggagatcaggaaccctgggatgctggggag

SEQ ID NO: 82471 - DNA, 201 bp, Homo sapiens
ggcctgtgtcccaggtgatcgacgccatctctggagccatcacacagaccccgggctgcgtgctgctggatgtggacgcaggcccttccaccaaccgcacygtgtacaccttcgtggggccgccggagtgcgtggtggagggggccctcaacgctgcccgggtagcttcccgacttatcgacatgagcaggcaccaaggtg

SEQ ID NO: 82472 - DNA, 201 bp, Homo sapiens
ggaggtgaggcccgaagagctggtcaagcatctagggctgatggggcagcttgagtggctaaggcccaggccatggaggaggtggtgggcttggtgtcccrggtcgtcttcccaggatgggcagagccgctgcccgtgggccccaaggacatcccgtggctcagggccctggggagtgcctgacccaggggtgggtggaac

SEQ ID NO: 82473 - DNA, 201 bp, Homo sapiens
tcccgggcggccgctgtgtgcgggcactttcggtgggagctcagcttgtcggagagcccccaaaggcttggcccgcctcctcagcccccatttgtgtctcrgggtgcagccacctccaagctccttttccttctttcaaacggggagactgaggtgtgggggccgggcctgtgtcccaggtgatcgacgccatctctggag

SEQ ID NO: 82474 - DNA, 201 bp, Homo sapiens
gccttgctggttaatgagaagccggtggggaggtgctgccggtgagcgtataaaggccctggcggcggctgcggagcactggccctgtccttccatctgcycagagaggagcatctggatcaaggtgctggccatgtcccagctggtggaatgcgtccccaacttttcggaggggaagaaccaggaggtgaggcccgaaga

SEQ ID NO: 82475 - DNA, 201 bp, Homo sapiens
gtgctgggtgtttgggaatgacttcccatcgcccgcttctgcagcctgctcagccctgttggggtgcagtgtgtccactgcctgcctgtgtgtgccgctgygctcaggctctcctcttgctcctttcaggcgcacggcggccctacaggagggtctgaggcgggcagtctctgtgccgctgacgctggcggagacggtggc

SEQ ID NO: 82476 - DNA, 201 bp, Homo sapiens
ggcagggccaaaggtgtgtggacacacgggcgctggccaggggctgggctgtgggccgctcatgagaggccagggatccacagtgatcctgaggggtggayggatgagaagcttatctctaagtggccagccctgggcggtggcggcaaaggcgggggaggctggcgtcccctggggtgggcgccgacccacggcttggtg

SEQ ID NO: 82477 - DNA, 201 bp, Homo sapiens
ggctcctggccgggcactgtccgcaggaggggaccccggggacccaggcgggcggggcagggatcggccctgggcctggaagtccccgtccgagggccccragccccccacccccatccatgcgctgcgcccgcagacctccaccaagtctctggacggctccgtggacgagaggaagctgcgcgagctgacgcagcgcta

SEQ ID NO: 82478 - DNA, 201 bp, Homo sapiens
cacagccccgcccgctcccagcctggccccttgggttttccactgggggaagcacccccctccccgggggggcccagggcacccaacacctgcttgcagarccctgctttctgggatgcgcttctcattaccgggcaggttaagcatgttccgtacatttagcagtggtttttacttcttttccaggaagttatctggtga

SEQ ID NO: 82479 - DNA, 201 bp, Homo sapiens
ctgcctctcgggccttgcggggcgctggggtccctgcgtggagacccggctgagtcctcccagcgcctccctttgggcgcctactcggcctgcgccaagcmggggtctgggggctgaggggggcacagagaccccggccgggtccccgcaggttctcagccgagtggtcacctccccgtgggtgcagacgggcgtggggcc

SEQ ID NO: 82480 - DNA, 201 bp, Homo sapiens
gcctcaggttccccaagggcaactcagggtgatggctgtttccagaagcctgtacggggtgcctgctggggcggggcccacagggctcctggcggggcagmggtggggggtgccagccacgcccctgccctgctccccgcaaaagcacctgtgtgctcggggcagggggcggctgccgcaagggtgggacccgcgggttcc

SEQ ID NO: 82481 - DNA, 201 bp, Homo sapiens
gcagggggagggaggccgggcagcctgcggagggcctggggagacctggggctgggcgggggccggggctacggggaccccgtgggaggagctggagaggygcaggcccagggcgtcgtccgagtgagcagcggtgctggccgtgtgggacccgggcccgcttagcaccatggacggggtgggctcacgaccctcgactgc

SEQ ID NO: 82482 - DNA, 201 bp, Homo sapiens
ggctgcagggggagggaggccgggcagcctgcggagggcctggggagacctggggctgggcgggggccggggctacggggaccccgtgggaggagctggaraggtgcaggcccagggcgtcgtccgagtgagcagcggtgctggccgtgtgggacccgggcccgcttagcaccatggacggggtgggctcacgaccctcga

SEQ ID NO: 82483 - DNA, 201 bp, Homo sapiens
atcctttctgtctaagcagcagctgtcgcttctccacatttccttgtcttcttatgtgtgaggccccgtctgctttccagtgtggcgttttgtcttcttcttttttttttttttttttgagatggagtctcactttgtcacccaggccggagtgcagtggtgtgatctcggctcactgcaacctccacctcccggattgaa

SEQ ID NO: 82484 - DNA, 201 bp, Homo sapiens
tcctttctgtctaagcagcagctgtcgcttctccacatttccttgtcttcttatgtgtgaggccccgtctgctttccagtgtggcgttttgtcttcttcttttttttttttttttttgagatggagtctcactttgtcacccaggccggagtgcagtggtgtgatctcggctcactgcaacctccacctcccggattgaag

SEQ ID NO: 82485 - DNA, 201 bp, Homo sapiens
gcttctccacatttccttgtcttcttatgtgtgaggccccgtctgctttccagtgtggcgttttgtcttcttcttttttttttttttttttgagatggagyctcactttgtcacccaggccggagtgcagtggtgtgatctcggctcactgcaacctccacctcccggattgaagcagttctctgcctcagcctctcgagt

SEQ ID NO: 82486 - DNA, 201 bp, Homo sapiens
tagcattttggaaaaccaaggtgggcaaatcccttgagctcaggtgtttgaaaccagcctagaccacacaccaagaccctgtatttacccacccaaaaagaaaaaaaaaaaataaagccaggcgtggtagcaggtacctgtggtcccagctactcaggaggcttaagtgggggtagcttgaggccaggagtttgaggctgc

SEQ ID NO: 82487 - DNA, 201 bp, Homo sapiens
gcgctccagccttggtgacagagcaagaccctgggtcaaaaacaacaaaacacgagaaagcacacaaggcagctcttggaagtagatgcctcacactgacrggccacagctgggcagagggtcccagagaaggagcgtctctctcatgggctcagcactttctgcagctgccctaagacctcatggtcttcgggttcttta

SEQ ID NO: 82488 - DNA, 201 bp, Homo sapiens
tttgcgtagtttttttgtgggatgggaaaaggaggaaaggaagagaaaataactgacgtactcccctggagctgcaggctgtgtggtcagatgacagagcrgtggagtatgaagaaaagagtgagtcttttcaaaggacaacaaagtttcagggtatccagagtgaactgcatttccccagtttcacatgttgactcctga

SEQ ID NO: 82489 - DNA, 201 bp, Homo sapiens
cctcgtcacgacaggattccagccaggctggcctgatgctcctgggggtcctcggcacatgccccttcaccctggcatgtgcttcttttccgggaacccayactctggctgagtggagccatcccctctgggtcaacagcacccggggtggctctgcagcaccccactccgcggctgcacagggaccttggccccactgct

SEQ ID NO: 82490 - DNA, 201 bp, Homo sapiens
acgggctgcctggaaggcctcccagaaggcagcacagggtcacgagggtcacccgcagtggcacagggaggcctcgtcacgacaggattccagccaggctsgcctgatgctcctgggggtcctcggcacatgccccttcaccctggcatgtgcttcttttccgggaacccacactctggctgagtggagccatcccctctg

SEQ ID NO: 82491 - DNA, 201 bp, Homo sapiens
ccatcgtgtttccagcctcctgcaggaagccaagacccaggctgcactggtgctggactgcttggagacccggcaggagtgacggtgcgggaggcctctcygggctctgtggcccctccctcgcccatccccagagggcagagctgtgacctcggtggggacacagcttgttcgtgtggggcccggagggtaggtgggcag

SEQ ID NO: 82492 - DNA, 201 bp, Homo sapiens
agacgaggcatttaaggaccaggtgagcaggaggcaggtgtggtgcccggaccccacgtgggggcctggattcacagcctcagggtgattgccgactggcygtgggcagtgggggtcggaggttgctgcccagcaagctgggctgaagactggaactaccagacccctctttccctgtgtccatcagatccaccatcgtgt

SEQ ID NO: 82493 - DNA, 201 bp, Homo sapiens
cggggctacggggaccccgtgggaggagctggagaggtgcaggcccagggcgtcgtccgagtgagcagcggtgctggccgtgtgggacccgggcccgcttmgcaccatggacggggtgggctcacgaccctcgactgcggggcccgggcggcggcgctagcagatccagcggatgaagcggtcgaagaagccgggttgcgc

SEQ ID NO: 82494 - DNA, 201 bp, Homo sapiens
tttggcgcatatttcaacgtgctcatcaacctgagggacatcacagacgaggcatttaaggaccaggtgagcaggaggcaggtgtggtgcccggaccccaygtgggggcctggattcacagcctcagggtgattgccgactggccgtgggcagtgggggtcggaggttgctgcccagcaagctgggctgaagactggaact

SEQ ID NO: 82495 - DNA, 201 bp, Homo sapiens
atcagcactctgtaaaatggaccaatcagcactctgtaaagtggaccaatcagcaggatgtgggcggggccaaataagggcataaaagctggccaccgaarccagcaagcgccaaccgtggcgggttctgttccaagctgtgggggctttgttcttttgctcttcgaactaaatcttgctgctgcttactctttgggcctt

SEQ ID NO: 82496 - DNA, 201 bp, Homo sapiens
cgtcaggcagagaccctccttccggcagtttgctcagccttgatccatgtaggggctccctggggtccttgcaggtggcggccaaagccctggagatgggygtgtttggcgcatatttcaacgtgctcatcaacctgagggacatcacagacgaggcatttaaggaccaggtgagcaggaggcaggtgtggtgcccggacc

SEQ ID NO: 82497 - DNA, 201 bp, Homo sapiens
gctcactgtgaaggtcggcggcctcacggggaggaagaaacagctcccgacgcgccacctgtaagagcttatggctcactgtgaaggtctgcggcctcacsgggaggaagaaacagctcccgacgcgccacctgtaagagctcactgagaaggtctccggcttcactcctgaagtcaggcaagaccacgaacccgccagaa

SEQ ID NO: 82498 - DNA, 201 bp, Homo sapiens
ggttcctagagtggcggagagcctccagtgtgactgctcccaggcctcctgtggggctgagccctgcttggataagagaaagttttgttttctaagctcartggtggggcttagccctctgtggggcgaaagcgggggctgcgctgggctccttgtgaggaggaggacgaagtccggcctgtcccagagcccgtcaggcag

SEQ ID NO: 82499 - DNA, 201 bp, Homo sapiens
tgaagctgcctccgggggccctccaggggatgactgtctctagaactgtggtcctggttcctagagtggcggagagcctccagtgtgactgctcccaggcytcctgtggggctgagccctgcttggataagagaaagttttgttttctaagctcagtggtggggcttagccctctgtggggcgaaagcgggggctgcgctg

SEQ ID NO: 82500 - DNA, 201 bp, Homo sapiens
gtcccagagcccgtcaggcagagaccctccttccggcagtttgctcagccttgatccatgtaggggctccctggggtccttgcaggtggcggccaaagccytggagatgggcgtgtttggcgcatatttcaacgtgctcatcaacctgagggacatcacagacgaggcatttaaggaccaggtgagcaggaggcaggtgtg

SEQ ID NO: 82501 - DNA, 201 bp, Homo sapiens
acggcggccctacaggagggtctgaggcgggcagtctctgtgccgctgacgctggcggagacggtggcctcgctgtggccggcgctgcaggaactggcccrgtgtgggaacctggcctgccggtcagacctccaggtaggggggcccgggggaccccaggcctcctgccgcaaagcaggaagcagctgttggggctgagtt

SEQ ID NO: 82502 - DNA, 201 bp, Homo sapiens
gggggagggaggccgggcagcctgcggagggcctggggagacctggggctgggcgggggccggggctacggggaccccgtgggaggagctggagaggtgcrggcccagggcgtcgtccgagtgagcagcggtgctggccgtgtgggacccgggcccgcttagcaccatggacggggtgggctcacgaccctcgactgcggg

SEQ ID NO: 82503 - DNA, 201 bp, Homo sapiens
ttgctcctttcaggcgcacggcggccctacaggagggtctgaggcgggcagtctctgtgccgctgacgctggcggagacggtggcctcgctgtggccggcsctgcaggaactggcccggtgtgggaacctggcctgccggtcagacctccaggtaggggggcccgggggaccccaggcctcctgccgcaaagcaggaagca

SEQ ID NO: 82504 - DNA, 201 bp, Homo sapiens
aggcccccaggtccggcctctcgccttccacagccctgaggtccaggctcctccgggaacaaacgcaggccctaagggccacctggaaggcctcccagagsgcagcaccaggccacaggggtcacccgcaggggtgcagggaggcctcgtcatgccgggattccagccagcaccaaggccctgggacagggcaagatttgg

SEQ ID NO: 82505 - DNA, 201 bp, Homo sapiens
gctgagccaggtagggagacctcacttcacgggcagttcccggggctttggcctcctccaacagggccggggtgtccgctgccttctaagatctcgctcayggcggcaccacagacggagacccaaatgtgtctgcagagcccaccctgaccactgtataagtgtatactcccccaagaccccttgtatcacccccactgt

SEQ ID NO: 82506 - DNA, 201 bp, Homo sapiens
acgtaacccccgtcacggtcatgccagtccccccgaaggaaatcccgacgcagggcccacgtcacagtcacactggtgtgcgggttcacgagtttttcctyttctctgccgttatatttatgtggttgcttgcggttctgtttatcatacaaagaaaacagaagcatgaacgtcctgccgttagcatgtcccacatgttcc

SEQ ID NO: 82507 - DNA, 201 bp, Homo sapiens
caatgcaaaggtcgacttttgaaaaacataaggagatatctgtaccttgcaccaaatacataagtaatttccagatggaatagaaaactgtatttccccaycaccaacacaaccaagcctcacgataaatcacagaaaacaaaacggaccgggcgggcaggcctcggccggacgcagatgaggccacctaaagcacaccct

SEQ ID NO: 82508 - DNA, 201 bp, Homo sapiens
tgtgtgccgctgtgctcaggctctcctcttgctcctttcaggcgcacggcggccctacaggagggtctgaggcgggcagtctctgtgccgctgacgctggyggagacggtggcctcgctgtggccggcgctgcaggaactggcccggtgtgggaacctggcctgccggtcagacctccaggtaggggggcccgggggaccc

SEQ ID NO: 82509 - DNA, 201 bp, Homo sapiens
tctgcagcctgctcagccctgttggggtgcagtgtgtccactgcctgcctgtgtgtgccgctgtgctcaggctctcctcttgctcctttcaggcgcacggyggccctacaggagggtctgaggcgggcagtctctgtgccgctgacgctggcggagacggtggcctcgctgtggccggcgctgcaggaactggcccggtgt

SEQ ID NO: 82510 - DNA, 201 bp, Homo sapiens
gcgtgctgggtgtttgggaatgacttcccatcgcccgcttctgcagcctgctcagccctgttggggtgcagtgtgtccactgcctgcctgtgtgtgccgcygtgctcaggctctcctcttgctcctttcaggcgcacggcggccctacaggagggtctgaggcgggcagtctctgtgccgctgacgctggcggagacggtg

SEQ ID NO: 82511 - DNA, 201 bp, Homo sapiens
atcttctggactttgaggtcacggcactgcacacggtctacgaggagacctgccgagaagcacaggtgagcccgggagcagccgctgctgctgtgaggggygagccgatctgtcccgtgggcagggcgggggccccacatcctccagccagggccattctccagccagcccccagggggtgacgctgcctgtgccttggca

SEQ ID NO: 82512 - DNA, 201 bp, Homo sapiens
gctctgcgtgcctccgggccccgccacgcgggctgcgcacgatggcattgatggcgtgcaccacgcctgcgcccacgtgcgagaaggagttcaggtattgygtggtctccagcgcctcgtggatggccgtgaggttgtggctcagcgggaaggccacctgctgctcgccggggccaccaaactgcagcagcgccacgcgtg

SEQ ID NO: 82513 - DNA, 201 bp, Homo sapiens
ggaaggcctcccagaaggcagcacagggtcacgagggtcacccgcagtggcacagggaggcctcgtcacgacaggattccagccaggctggcctgatgctmctgggggtcctcggcacatgccccttcaccctggcatgtgcttcttttccgggaacccacactctggctgagtggagccatcccctctgggtcaacagca

SEQ ID NO: 82514 - DNA, 201 bp, Homo sapiens
acataggaacaattttatgtttagaaatttaaaataaggtgaataattaaaaaacaagtaggaaaagtacatagatgaaaatgtaatcaagggacaggaargaaacaagacgtgtggtttagagaaccatgagcggggacagtgagactgtgctaggcatcagtggtcgaaatcagtggattggtttacgctccctgtgag

SEQ ID NO: 82515 - DNA, 201 bp, Homo sapiens
cacactggctgggaggacggtgcgggaacttccgttgtcccgggagggctggtgctgccgctggggcagggctgggagcgcccagggccggcctcctcccygtgggtcagtgtgagcagcttgctgggtgtgtggactgggggctgcccaggccggagaggacagagggtccgagaaccccgtggagctcccacccgctcc

SEQ ID NO: 82516 - DNA, 201 bp, Homo sapiens
atcagcaggatgtgggcggggccaaataagggcataaaagctggccaccgaaaccagcaagcgccaaccgtggcgggttctgttccaagctgtgggggctwtgttcttttgctcttcgaactaaatcttgctgctgcttactctttgggccttcgctacctttacgacctgtaacactcactgccaaggtgtgtagcttca

SEQ ID NO: 82517 - DNA, 201 bp, Homo sapiens
agtttgaggctgcagtgagtcgtgattgcaccactgcactctagcctgggcaacagaacgacaccctgtctctaatgtaaacatatgtatataaaacatargaacaattttatgtttagaaatttaaaataaggtgaataattaaaaaacaagtaggaaaagtacatagatgaaaatgtaatcaagggacaggaaggaaac

SEQ ID NO: 82518 - DNA, 201 bp, Homo sapiens
cctgtaacactcactgccaaggtgtgtagcttcactcctcaagtcagcgagaccaccaacccaccgggaggagctaacagctgtgctacgcgccacctgtragagctgtaacactcgctgcgaaggtcggcggcctcacggggaggaagaaacagctcccgacgcgccacctgtaagagcttaacgctcactgtgaaggtc

SEQ ID NO: 82519 - DNA, 201 bp, Homo sapiens
aaacgcaccaatcagcactctttaaaaacggaccaatcagcactctgtaaaatggaccaatcagcactctgtaaagtggaccaatcagcaggatgtgggcrgggccaaataagggcataaaagctggccaccgaaaccagcaagcgccaaccgtggcgggttctgttccaagctgtgggggctttgttcttttgctcttcg

SEQ ID NO: 82520 - DNA, 201 bp, Homo sapiens
agcaaggcagggcccttctttagaagcctgcaattccaggaaaggaggcctgcaagaatctcaggaacacagtgatgagtgctctcaggcaggccagagasgacccgtttcagccacagcataagacagaaacaccatcttcagataacacccactcaggcaggcagtgaccccacctccctccaaacgggacaggaacat

SEQ ID NO: 82521 - DNA, 201 bp, Homo sapiens
ggtgcctgctggggcggggcccacagggctcctggcggggcagaggtggggggtgccagccacgcccctgccctgctccccgcaaaagcacctgtgtgctyggggcagggggcggctgccgcaagggtgggacccgcgggttccgaggctttcctggtggtggagacgcgccgaggccgtttccactccaagccccttttc

SEQ ID NO: 82522 - DNA, 201 bp, Homo sapiens
ggagggagcccctccacctgcgtcctccaggaactgagtcctggaccccctgccggtccaggcctgaccgccgggctctcctgcagtttacctgtacggcraggcagccaggatggacagtcgccggaccctgccggccatccgggccggggagtacgaggccctccctaagaaggtgcccccaccccgggcggtcgggcc

SEQ ID NO: 82523 - DNA, 201 bp, Homo sapiens
tagacccggacaggcatttgaagacagtcatgaatttaagtataaatattagaaataggccaggcatgatagctcacacctgtaatcctagcattttggaraaccaaggtgggcaaatcccttgagctcaggtgtttgaaaccagcctagaccacacaccaagaccctgtatttacccacccaaaaagaaaaaaaaaaaat

SEQ ID NO: 82524 - DNA, 201 bp, Homo sapiens
atacatatgagccaggcacggtggtgcctgtggtcccagctacttgggaggctgaggcaggagaattgcttgagcacaggaggtcaaggctgcagtgagcygtgatcacaccactgcgctccagccttggtgacagagcaagaccctgggtcaaaaacaacaaaacacgagaaagcacacaaggcagctcttggaagtaga

SEQ ID NO: 82525 - DNA, 201 bp, Homo sapiens
tttgtaaacacaccagtcagcactgtgtctagctactggggtgggaacttggagaacttctctgtctagctaaagtattgtaaaaacgcaccagtcagtgstctgtgtctagctaaaggtttgtaaacgcaccaatcagcactctttaaaaacggaccaatcagcactctgtaaaatggaccaatcagcactctgtaaagt

SEQ ID NO: 82526 - DNA, 201 bp, Homo sapiens
acccttggccaagatctgcccagggagaccatggacaccgcaaggcctgggtgtgagagagtgttcgtagcgcgagtcgcagcttgaggatggctgtcctkcctccgcctgcaactgctacagacccttgtgcagaggacagcctgggagaggggctgcagccaggaggcctggtctggatgatgccccagccagtcaggg

SEQ ID NO: 82527 - DNA, 201 bp, Homo sapiens
gacccggcaggagtgacggtgcgggaggcctctccgggctctgtggcccctccctcgcccatccccagagggcagagctgtgacctcggtggggacacagyttgttcgtgtggggcccggagggtaggtgggcaggcagcggggcatcgcctgggaatggaggcgctggcagggacagaaggcccctagtcccatgtgacc

SEQ ID NO: 82528 - DNA, 201 bp, Homo sapiens
atacctcttctgcagtcttgaaaagtgattgggaaagaaatacactgaaaactacaaacatcactgaaaggaatgaaagaagacataaatgaccaggcacrgtggctcacacctgtaatcccaacattttggaaggctgagatgggcagatctcttgagcccaggagttcaagaccagcctcagcaacagggcgaaacccc

SEQ ID NO: 82529 - DNA, 201 bp, Homo sapiens
ctgtaatcccaacattttggaaggctgagatgggcagatctcttgagcccaggagttcaagaccagcctcagcaacagggcgaaaccccatctctaccaascccccaccacccaagttagctggtcgtggtggtgcatgcctgtagttccagctattcaggaggctgaggtgggaggatcactcaagcccagaaggtagag

SEQ ID NO: 82530 - DNA, 201 bp, Homo sapiens
ttttggaaggctgagatgggcagatctcttgagcccaggagttcaagaccagcctcagcaacagggcgaaaccccatctctaccaaccccccaccacccamgttagctggtcgtggtggtgcatgcctgtagttccagctattcaggaggctgaggtgggaggatcactcaagcccagaaggtagaggttgcagtgagctg

SEQ ID NO: 82531 - DNA, 201 bp, Homo sapiens
gccccaggggtccaggctcctccaggaacaaacgcaggccccacgggctgcctggaaggcctcccagaaggcagcacagggtcacgagggtcacccgcagkggcacagggaggcctcgtcacgacaggattccagccaggctggcctgatgctcctgggggtcctcggcacatgccccttcaccctggcatgtgcttcttt

SEQ ID NO: 82532 - DNA, 201 bp, Homo sapiens
gacggcaagcccctcttcgcctggtgagccgccccgcgcccgccgccttgcctgcagtaaacgcgtttgttccaacccggggccgcggtgcctcctgcgcrtccccccggaggggaaagggccgcgtcccccgcgcgcgaggccagagaaggccccgctcccaccggtgctgggccccgaccgcagcccgccgctgcccgc

SEQ ID NO: 82533 - DNA, 201 bp, Homo sapiens
accccatctctaccaaccccccaccacccaagttagctggtcgtggtggtgcatgcctgtagttccagctattcaggaggctgaggtgggaggatcactcragcccagaaggtagaggttgcagtgagctgagatcgtgccactgcactccagcttgggtgacagagcgagaccctttcttcaaaaaaacaaacaaacaaa

SEQ ID NO: 82534 - DNA, 201 bp, Homo sapiens
gcagctttgatgtcttctctgcctccgtctttactttctcttccactcctttcctctggattcacagtggttttccaaaacccagcctcaatcattggtgygtttgtggccttgtctgttgtattcttggctgttaacaaaattttttgtgactttacattttgtataatttcttacagagaagatacaggtggccctcca

SEQ ID NO: 82535 - DNA, 201 bp, Homo sapiens
atcaatgcaatggaatgggaaggtcagaaataaaactgtacatagatggttttcaacaagagtgccaagacaattcaggagggactgaatactgtctaacrcgtggtgctggaacaaagaggtatccacatgccaaggaatgaggctgggccttactccacaccacatacacaaattaactcaaaatggatcaaagaccta

SEQ ID NO: 82536 - DNA, 201 bp, Homo sapiens
ggacagaagggagccgaggacagggggaagggaaggctggcttgccctttggcactttaagaagctccttttctttcagattctatttgccagacagtggrgggtggcggcaggtgggaggaggggggtggaggagccgccccccacgtggccgagggcaccctcgagggcagtggatcctcgcgctcccctgaccttgtc

SEQ ID NO: 82537 - DNA, 201 bp, Homo sapiens
cttgtctgttgtattcttggctgttaacaaaattttttgtgactttacattttgtataatttcttacagagaagatacaggtggccctccactcctgcctyccacccatattttccaagtgcttgcattttgccccatttatttgtgtataatcatattatatttttttccggactatttaaaagttgggttgaagacatt

SEQ ID NO: 82538 - DNA, 201 bp, Homo sapiens
tgcaacggtccagccccgcaggcagtgagcaaagctctgaacacagcagggtgacctcacgctgcaccgcagccttcacagaacgcttgagacatggacgycgtctgagcacgcacgagctggcagatggggttccctcagtgagcttatgagtgacgcagctcattcagtgaaaggaagggcagcctccctgttaaggcc

SEQ ID NO: 82539 - DNA, 201 bp, Homo sapiens
agtatcaaaaaaatgaaaagccaacccggagaatgggagaaaacatttgtaaattgtgcgtttgaaatgggactagtatgcagaatatttaagaactctgmcaattcaacagtaagaagacaaacaatccaatgaaaaatcactacaggacctgaatagatatttctccaaagaagatacagtatataaatggccaataag

SEQ ID NO: 82540 - DNA, 201 bp, Homo sapiens
cgtggagggcgcctcggccgctgctccgcctgcaggaagcgccgctcggtgctcaaggagggaagccaggaaggagccgcagccggcaggggccccctctyccccctccccccttcccctcccccgggcctccacgcccacccgctttcccgcccgggacggcgagtcctgtcccagtttgggtttccccgaatgccgagc

SEQ ID NO: 82541 - DNA, 201 bp, Homo sapiens
agcgccggcgtcacaaccagccccattccccctcgtgttctcagctgtagccaagccctggtccagcagtagctgggtaggaaatgcatgcagctcctgcyggggcctcccgccccaaccctctctcctgacaggcgatttgctgggctggaggacagggccaggtcttggccttggcaccgtcctgggtcacgagtgtat

SEQ ID NO: 82542 - DNA, 201 bp, Homo sapiens
agagcctagggcaggggccagagagcctgggaaagggcagtgacaaggtcaggatgctcccaagcagttccagcccaggagaggacaggagggaagggcasaaaagagagagagagggaggggagagagaagagagggagagtggggagagaggcagatggcggagagagagagggagggagggatggggagggagggagg

SEQ ID NO: 82543 - DNA, 201 bp, Homo sapiens
gacagcctgggagaggggctgcagccaggaggcctggtctggatgatgccccagccagtcagggagacactgggcatttctgttcctcgatcactgctgtyggaatggtcaaaggatccagatctggctggcgcccagggagcatttgctctcatccatggtcgagggtaggggctgttgatgatgactttctggtggaga

SEQ ID NO: 82544 - DNA, 201 bp, Homo sapiens
gctcggagccgtccagcaggaagacgatgtccacgggccgctgcgtgcactgtgccacggacagctctgtggggagacgcaggtgcgggctgggcggaggrgaggtgggcaggaccgggcaggtgccagccccgcacctgtgcccttccattcgcaccctgcctgcaacctcacagaccactgggctctgcgggggcgttt

SEQ ID NO: 82545 - DNA, 201 bp, Homo sapiens
aagagcttaacgctcactgtgaaggtcggcggcctcacggggaggaagaaacagctcccgacgcgccacctgtaagagcttatggctcactgtgaaggtckgcggcctcaccgggaggaagaaacagctcccgacgcgccacctgtaagagctcactgagaaggtctccggcttcactcctgaagtcaggcaagaccacga

SEQ ID NO: 82546 - DNA, 201 bp, Homo sapiens
ggccgtgaggttgtggctcagcgggaaggccacctgctgctcgccggggccaccaaactgcagcagcgccacgcgtgcgttgagagggtcgtcgtccctcygggccagcgtcagccgccgcgccacctgctccacgaagcgccgggccttgtggaagttctgctcacccagccgctcggagccgtccagcaggaagacgat

SEQ ID NO: 82547 - DNA, 201 bp, Homo sapiens
tcctgccactgactgaaagggctgtgtgaggtcacacgaggtggcccagcatggtccccactgccgcctctccatctccactggagttagcttgctgagcycccaccctgcagccaccatcctcactggacccaaaacgaagtaggcacagagggggcagcaggcccccaggtccggcctctcgccttccacagccctgag

SEQ ID NO: 82548 - DNA, 201 bp, Homo sapiens
ctttcggtggggggttgggcagatctctgggcctcaaagggccttggtgctcccccctgaaaatggggctcctgccactgactgaaagggctgtgtgaggycacacgaggtggcccagcatggtccccactgccgcctctccatctccactggagttagcttgctgagctcccaccctgcagccaccatcctcactggacc

SEQ ID NO: 82549 - DNA, 201 bp, Homo sapiens
gcgggctgcgcacgatggcattgatggcgtgcaccacgcctgcgcccacgtgcgagaaggagttcaggtattgtgtggtctccagcgcctcgtggatggcmgtgaggttgtggctcagcgggaaggccacctgctgctcgccggggccaccaaactgcagcagcgccacgcgtgcgttgagagggtcgtcgtccctccggg

SEQ ID NO: 82550 - DNA, 201 bp, Homo sapiens
ttgagtggctaaggcccaggccatggaggaggtggtgggcttggtgtcccgggtcgtcttcccaggatgggcagagccgctgcccgtgggccccaaggacrtcccgtggctcagggccctggggagtgcctgacccaggggtgggtggaacacgactggtgcttgtgggggctgaggcttggctgtggcttcaggggcctt

SEQ ID NO: 82551 - DNA, 201 bp, Homo sapiens
ttctgcttgcgcatggagtgcgccgactcgtgcagactgtcgttgcccgtgacgccgtccgtgaggaacacgaaggacagctctgcgtgcctccgggcccygccacgcgggctgcgcacgatggcattgatggcgtgcaccacgcctgcgcccacgtgcgagaaggagttcaggtattgtgtggtctccagcgcctcgtgg

SEQ ID NO: 82552 - DNA, 201 bp, Homo sapiens
gcccagagaggagcatctggatcaaggtgctggccatgtcccagctggtggaatgcgtccccaacttttcggaggggaagaaccaggaggtgaggcccgargagctggtcaagcatctagggctgatggggcagcttgagtggctaaggcccaggccatggaggaggtggtgggcttggtgtcccgggtcgtcttcccagg

SEQ ID NO: 82553 - DNA, 201 bp, Homo sapiens
ttagcaccatggacggggtgggctcacgaccctcgactgcggggcccgggcggcggcgctagcagatccagcggatgaagcggtcgaagaagccgggttgygccaggctgtcatagtccttctcgtggaacacggcggcgcggtcacccaggctgagcgtggtgagcacgtccatgtccacgtcgctgcccaaggccagca

SEQ ID NO: 82554 - DNA, 201 bp, Homo sapiens
ggcccgcttagcaccatggacggggtgggctcacgaccctcgactgcggggcccgggcggcggcgctagcagatccagcggatgaagcggtcgaagaagcygggttgcgccaggctgtcatagtccttctcgtggaacacggcggcgcggtcacccaggctgagcgtggtgagcacgtccatgtccacgtcgctgcccaag

SEQ ID NO: 82555 - DNA, 201 bp, Homo sapiens
ctggaggctgaggcaggagaatggcgtgaacccgggaggcagagcttgcagtgagccaagatcgcaccactgcactccagcctgggcgacagagcgagacyctgtctcaaaaaaaaaaaaaaaaaaaaaaaaaaagaacttcaagtggggctgggctcagtggctcacacttgtaattccagcactttgggaggccgaggc

SEQ ID NO: 82556 - DNA, 201 bp, Homo sapiens
gaccccgtgggaggagctggagaggtgcaggcccagggcgtcgtccgagtgagcagcggtgctggccgtgtgggacccgggcccgcttagcaccatggacrgggtgggctcacgaccctcgactgcggggcccgggcggcggcgctagcagatccagcggatgaagcggtcgaagaagccgggttgcgccaggctgtcata

SEQ ID NO: 82557 - DNA, 201 bp, Homo sapiens
gcccagagtacaagatcaaagtgtctgcagattctgtttgtctgaggtctctctgcttggcttgcaggcggccgcctccctgctttgtcctcctggccttktctctgagtgcatccctggtgtctctccctcttctcaccgccctgtccatctccacatccaatccagtcggcggtgctgggggtaatccagtctgccatg

SEQ ID NO: 82558 - DNA, 201 bp, Homo sapiens
agcaggtgcgccccgtggggagggcgcggccaggagggtgcggggcgctcggtccgtccctgtgcggcccccagatcttggctcctggccgggcactgtcygcaggaggggaccccggggacccaggcgggcggggcagggatcggccctgggcctggaagtccccgtccgagggccccgagccccccacccccatccatg

SEQ ID NO: 82559 - DNA, 201 bp, Homo sapiens
ctggccgtgtgggacccgggcccgcttagcaccatggacggggtgggctcacgaccctcgactgcggggcccgggcggcggcgctagcagatccagcggakgaagcggtcgaagaagccgggttgcgccaggctgtcatagtccttctcgtggaacacggcggcgcggtcacccaggctgagcgtggtgagcacgtccatg

SEQ ID NO: 82560 - DNA, 201 bp, Homo sapiens
cacagaaatttattctatcacagtcctgaaggcccagagtacaagatcaaagtgtctgcagattctgtttgtctgaggtctctctgcttggcttgcaggcrgccgcctccctgctttgtcctcctggccttttctctgagtgcatccctggtgtctctccctcttctcaccgccctgtccatctccacatccaatccagtc

SEQ ID NO: 82561 - DNA, 201 bp, Homo sapiens
gggcgggggccggggctacggggaccccgtgggaggagctggagaggtgcaggcccagggcgtcgtccgagtgagcagcggtgctggccgtgtgggacccsggcccgcttagcaccatggacggggtgggctcacgaccctcgactgcggggcccgggcggcggcgctagcagatccagcggatgaagcggtcgaagaagc

SEQ ID NO: 82562 - DNA, 201 bp, Homo sapiens
cggctctacggcttcacggtggccaacatccccgagaagatcgagcaggtgcgccccgtggggagggcgcggccaggagggtgcggggcgctcggtccgtycctgtgcggcccccagatcttggctcctggccgggcactgtccgcaggaggggaccccggggacccaggcgggcggggcagggatcggccctgggcctgg

SEQ ID NO: 82563 - DNA, 201 bp, Homo sapiens
actgcggggcccgggcggcggcgctagcagatccagcggatgaagcggtcgaagaagccgggttgcgccaggctgtcatagtccttctcgtggaacacggyggcgcggtcacccaggctgagcgtggtgagcacgtccatgtccacgtcgctgcccaaggccagcacggtgggtaccacgttctgcttgcgcatggagtgc

SEQ ID NO: 82564 - DNA, 201 bp, Homo sapiens
ggctcacagctggtgggcctggtgcccctgaaggctctgctggatgcggccgccttctactgcgagaaggagaacctcttcatcctggaggaggagcagcsgatcaggctggtgggccgggctgccgaggaagggtcggacaggggcgtgcagggagggtggggaggcggtggcggagctcacagccctggggcgcagctt

SEQ ID NO: 82565 - DNA, 201 bp, Homo sapiens
gccgctgctgctgtgaggggcgagccgatctgtcccgtgggcagggcgggggccccacatcctccagccagggccattctccagccagcccccagggggtracgctgcctgtgccttggcaggagctgagcctcccagtggtgggctcacagctggtgggcctggtgcccctgaaggctctgctggatgcggccgccttct

SEQ ID NO: 82566 - DNA, 201 bp, Homo sapiens
aggccttcagcagatggtttctcgagggaatgcagtgcggccctcaacagaccccatcctcccctcctggcctccagacatggatccctgactccatcctycccttgaggctccacagagctctgaccccatcctcccctcctggtctccctccagacacagatccctgaccccatcccccactcccagcctccagacgtg

SEQ ID NO: 82567 - DNA, 201 bp, Homo sapiens
agtggggcccccacctgcctgggtggtcaccagccctgggcatcggggacagcttgggggcctggccatagccacaacccaggccaggctgcctaccacaygtgtgggtgtcacgtggggccagagaccacaggacaggacacggacagtccttgcgtggacctggccctgtggcctcaccaagacctcagctcctgggat

SEQ ID NO: 82568 - DNA, 201 bp, Homo sapiens
gtgagacctcatgtgtatttgtctgataaagacatacgcaagactgggtaatttttaaagaaaaagcagtttaatggactcaacagttccacaatcatggkggaaggtgaaagaggagcaaagtcacgtcttacaagagggtgtgtgcaggggaactgccctttataaaaccatcggatctcgtgagaccattcactatca

SEQ ID NO: 82569 - DNA, 201 bp, Homo sapiens
catggtggaaggtgaaagaggagcaaagtcacgtcttacaagagggtgtgtgcaggggaactgccctttataaaaccatcggatctcgtgagaccattcastatcacaaaaacagcaccggaaaaagccgcccccgtgattcagtgacctcccaccgggtccctcccatgacgtgggaactatgggctctacaattcaaga

SEQ ID NO: 82570 - DNA, 201 bp, Homo sapiens
agagtccccccacgtggactcagtcaccccgacaagtgcggggctgaggggacttgtcgggagcggagcagatgggatgggagaacggcatgggggtgccyggggccccacccctcagcattcccccaacatctaggacacagcgtggctggaaggcagggcctaggctgggcgggggcctgccggggtgggcctccggtg

SEQ ID NO: 82571 - DNA, 201 bp, Homo sapiens
gtgccaccgcacttggctaatttttgtattttttttttttagtagagacggggtttcaccatcttggccaggctggtcttgaactcctgacctcgtgatcygtccgcctcagcctcccaaagcactgggattacaggcgtgagccaccgtgactggctggggttttgtcttctttacctgaagggccccatgcctgcggcc

SEQ ID NO: 82572 - DNA, 201 bp, Homo sapiens
cctcggtctcttgcctgggcacctggctggcttgccgcccacaagagggagatggggagggggggtagggagagagggaggggagtggggagagagggagstggggagagagacagggagggacagagtgggagggagggagagagaaacatgtgccccagcctctggagcagggcggtgggggcgcctgtgtttctggga

SEQ ID NO: 82573 - DNA, 201 bp, Homo sapiens
gctccctgtgagccacgtgaaggtggacggggagtgctggattggtttacgctccctgtgagcaatgtgaaggcagacggggagtgctggattggtttacrctccctgtgagcaatgtgaaggctgacggggagtgctggattggtttacgctccctgtgagccacgtgaaggtggacggggagtgctgggttggtttacg

SEQ ID NO: 82574 - DNA, 201 bp, Homo sapiens
gggggagtgctgggttggtttacactccctctgagcaatgcgaaggtggacggggagggctgggttgatttacattccctgtgaacaatgtgaaggtggayggggagtgctgcattggtttacgcaccctgtgaggcacgtgaaggtggacggggagtgctgggttggtgtacactccctgtgagcaatgtgaaggtggac

SEQ ID NO: 82575 - DNA, 201 bp, Homo sapiens
cactctgctgtggtgcgaggatgaaggtgccagcccagtgtgggcaaccctcacagccagaatgttccagtgccccgcacctcgggaccctggatgtgtgyggctgccgtcacaaagtaccgcagacccagcagcttaaaccacagaaatttattctatcacagtcctgaaggcccagagtacaagatcaaagtgtctgca

SEQ ID NO: 82576 - DNA, 201 bp, Homo sapiens
cgagtgtatggttctggtcactctgctgtggtgcgaggatgaaggtgccagcccagtgtgggcaaccctcacagccagaatgttccagtgccccgcacctygggaccctggatgtgtgcggctgccgtcacaaagtaccgcagacccagcagcttaaaccacagaaatttattctatcacagtcctgaaggcccagagtac

SEQ ID NO: 82577 - DNA, 201 bp, Homo sapiens
ctaatgtctcagtgctgcccctgagaaccagcgccggcgtcacaaccagccccattccccctcgtgttctcagctgtagccaagccctggtccagcagtakctgggtaggaaatgcatgcagctcctgccggggcctcccgccccaaccctctctcctgacaggcgatttgctgggctggaggacagggccaggtcttggc

SEQ ID NO: 82578 - DNA, 201 bp, Homo sapiens
ctatgtttgtctcatactctgggttagaaaagtgtatggcctgcctggccctggaatcagtagccctgggcctgtcactggggagagatggtggaaaccckggtgtgggcatagctgagattctttctcctgtaagtggggtcccttagggtccccgattcaggagctatttacagcacctgccagcatttctaatgtctc

SEQ ID NO: 82579 - DNA, 201 bp, Homo sapiens
ctgactttaaaggagagtgtgtcacaaagtactgcagacccagctacttaaaccacaggagggcacgtaccgtgccacacagggccgcccggggcggggcrccgtggcaacaggacgcagaaggcgagaggggagagcatggccagaggctctgtgggggtttccctgggaagagaggccagggagggtaggcacgaagga

SEQ ID NO: 82580 - DNA, 201 bp, Homo sapiens
gagtcctggaccccctgccggtccaggcctgaccgccgggctctcctgcagtttacctgtacggcgaggcagccaggatggacagtcgccggaccctgccrgccatccgggccggggagtacgaggccctccctaagaaggtgcccccaccccgggcggtcgggcctgggaaggaggtggacctgcccctttgtcctggct

SEQ ID NO: 82581 - DNA, 201 bp, Homo sapiens
ggaggcctctccgggctctgtggcccctccctcgcccatccccagagggcagagctgtgacctcggtggggacacagcttgttcgtgtggggcccggaggrtaggtgggcaggcagcggggcatcgcctgggaatggaggcgctggcagggacagaaggcccctagtcccatgtgacctccagtaaagttttggcaccaaa

SEQ ID NO: 82582 - DNA, 201 bp, Homo sapiens
cagcgagtggatactttcagcaagcctgggataggaagggctgtgatgaaacgcaccaggatttatttcagttgggtgtggtgggatacagacacaggacycctgactttaaaggagagtgtgtcacaaagtactgcagacccagctacttaaaccacaggagggcacgtaccgtgccacacagggccgcccggggcgggg

SEQ ID NO: 82583 - DNA, 201 bp, Homo sapiens
ggcgagcacaggggagccccggagaccatgggggtgccgggggtgggcgagcgccggggagccccagagaccgtgggagtgttgggggtgggcgaggacargggagccccgagaccgtgggggtgccgggggtgggcgagcgccggggagccccggagaccatgggggtgctgggggtggacgagcacaggggagccccgg

SEQ ID NO: 82584 - DNA, 201 bp, Homo sapiens
gcaccgcagccttcacagaacgcttgagacatggacgccgtctgagcacgcacgagctggcagatggggttccctcagtgagcttatgagtgacgcagctyattcagtgaaaggaagggcagcctccctgttaaggccacacctaggaaccggcttaaatgtccagaaactcctcaggtaccgctgggcttcccaaacccc

SEQ ID NO: 82585 - DNA, 201 bp, Homo sapiens
gccccgcaggcagtgagcaaagctctgaacacagcagggtgacctcacgctgcaccgcagccttcacagaacgcttgagacatggacgccgtctgagcacrcacgagctggcagatggggttccctcagtgagcttatgagtgacgcagctcattcagtgaaaggaagggcagcctccctgttaaggccacacctaggaac

SEQ ID NO: 82586 - DNA, 201 bp, Homo sapiens
agacgggagggcagtgagcttctaggggatgatttccacctcctgggacggaggtgggcaccggcccaagtgaactcggattctcctgcacacagcttccrtattcagtcatttacttatgggcccactatgtttgtctcatactctgggttagaaaagtgtatggcctgcctggccctggaatcagtagccctgggcctg

SEQ ID NO: 82587 - DNA, 201 bp, Homo sapiens
gtacctgcactctcacacgtgtgctcccctaccccacactcacatgtatcctcgctcactctcacacgtgttcccctgtcctgtgctcacatgtatccacrctctcacacatgtgctcccctgccttgtgctcacgtgtatctgcactctcacgtgttcccctgccctgccctcacgtgtatcctcactcactctcacacg

SEQ ID NO: 82588 - DNA, 201 bp, Homo sapiens
tcaccttcttggatccccggccacgtctctggcatctgtctgtcggagcagagcccgtgagtctctcctggaggcaccacctgcagccccttgtggggacygtgcttgggcctggagtgactgtggctgctgtgagggttcccgggcggccgctgtgtgcgggcactttcggtgggagctcagcttgtcggagagccccca

SEQ ID NO: 82589 - DNA, 201 bp, Homo sapiens
gcagccccttgttcaaaagcgaagaattcgaaagggcaacagccgcgttacagtgaacccggaccttagggctgagcagtggcaacgcaggcgggagagcrccggggagccccgagaccgtgggggtgctgggggtgggcgagcacaggggagccccggagaccatgggggtgccgggggtgggcgagcgccggggagccc

SEQ ID NO: 82590 - DNA, 201 bp, Homo sapiens
aggggaggctggggaggggaggctgggagggaacgctggggaggggaggctgggaggggaggctgggagggaacgctggggaggggaggctgggagggaaygctggggaggggaggctgggaggggagtctgggaggggagactggggaggggactcaggagggaaggctgggaggggacattggtgaggggacattggtg

SEQ ID NO: 82591 - DNA, 201 bp, Homo sapiens
ggagctgtgggtagagcctgtaggtagctggaagtcccttccagtgggactgacgttcctgccctgcagggtccgaggctgcacacgtgggagctggcacragagaggggagcgccctctccctgcagaggccctgggcagctcctgtgtagctcctgtgggtggagcctgtgcacctgcaggggcctctgcctccctcca

SEQ ID NO: 82592 - DNA, 201 bp, Homo sapiens
ggctgagccctggtccagtgtgactcgggtgagctcatcccggaataggctgagccctggtccagtgtgactcgggtgagctcatcccggaataggctgakccctggtccagtgtgactcgggtgagctcatcctagaataggctgagccctggtccagtgtgactcgggtgagctcatcccggaataggctgagccctgg

SEQ ID NO: 82593 - DNA, 201 bp, Homo sapiens
tcatcccggaataggctgagccctggtccagtgtgactcgggtgagctcatcccggaataggctgagccctggtccagtgtgactcgggtgagctcatccyagaataggctgagccctggtccagtgtgactcgggtgagctcatcccggaataggctgagccctggtccagtgtgactcgggtgagcttatcccaggata

SEQ ID NO: 82594 - DNA, 201 bp, Homo sapiens
catcccggaataggctgagccctggtccagtgtgactcgggtgagctcatcccggaataggctgagccctggtccagtgtgactcgggtgagctcatcctrgaataggctgagccctggtccagtgtgactcgggtgagctcatcccggaataggctgagccctggtccagtgtgactcgggtgagcttatcccaggatag

SEQ ID NO: 82595 - DNA, 201 bp, Homo sapiens
ggttgtggctcagcgggaaggccacctgctgctcgccggggccaccaaactgcagcagcgccacgcgtgcgttgagagggtcgtcgtccctccgggccagygtcagccgccgcgccacctgctccacgaagcgccgggccttgtggaagttctgctcacccagccgctcggagccgtccagcaggaagacgatgtccacgg

SEQ ID NO: 82596 - DNA, 201 bp, Homo sapiens
cggggcccgggcggcggcgctagcagatccagcggatgaagcggtcgaagaagccgggttgcgccaggctgtcatagtccttctcgtggaacacggcggcrcggtcacccaggctgagcgtggtgagcacgtccatgtccacgtcgctgcccaaggccagcacggtgggtaccacgttctgcttgcgcatggagtgcgccg

SEQ ID NO: 82597 - DNA, 201 bp, Homo sapiens
acccgaaactcggtttctgggggccctggaggtgcaacggtccagccccgcaggcagtgagcaaagctctgaacacagcagggtgacctcacgctgcaccrcagccttcacagaacgcttgagacatggacgccgtctgagcacgcacgagctggcagatggggttccctcagtgagcttatgagtgacgcagctcattca

SEQ ID NO: 82598 - DNA, 201 bp, Homo sapiens
ccaacccctggacgtcgtcacagctggtacatggacccccaggaatgcacacagaggaccctgacccgaaactcggtttctgggggccctggaggtgcaayggtccagccccgcaggcagtgagcaaagctctgaacacagcagggtgacctcacgctgcaccgcagccttcacagaacgcttgagacatggacgccgtct

SEQ ID NO: 82599 - DNA, 201 bp, Homo sapiens
agggtgtctgcttctcagcccaacccctggacgtcgtcacagctggtacatggacccccaggaatgcacacagaggaccctgacccgaaactcggtttctsggggccctggaggtgcaacggtccagccccgcaggcagtgagcaaagctctgaacacagcagggtgacctcacgctgcaccgcagccttcacagaacgct

SEQ ID NO: 82600 - DNA, 201 bp, Homo sapiens
caggagtgacggtgcgggaggcctctccgggctctgtggcccctccctcgcccatccccagagggcagagctgtgacctcggtggggacacagcttgttcrtgtggggcccggagggtaggtgggcaggcagcggggcatcgcctgggaatggaggcgctggcagggacagaaggcccctagtcccatgtgacctccagta

SEQ ID NO: 82601 - DNA, 201 bp, Homo sapiens
tgtggacgcaggcccttccaccaaccgcaccgtgtacaccttcgtggggccgccggagtgcgtggtggagggggccctcaacgctgcccgggtagcttccygacttatcgacatgagcaggcaccaaggtgaggtctctgggctctcctgtggctgccgtgtctcagaatgtcagggccgagccctgtcctggtgtcctgg

SEQ ID NO: 82602 - DNA, 201 bp, Homo sapiens
gagggggtaggcccggggcccaggcttggaacgtggggtccagtggggctggctctggctctcctaggaggaccctggagtgtgggggtcatggcccccakcctgcctgcagggctgtgctctgggggacccccaggtcgccacgctcccacagcaccgggccaccttcacggctgggtggggggagggggccacgccggg

SEQ ID NO: 82603 - DNA, 201 bp, Homo sapiens
tggggctggctctggctctcctaggaggaccctggagtgtgggggtcatggcccccagcctgcctgcagggctgtgctctgggggacccccaggtcgccaygctcccacagcaccgggccaccttcacggctgggtggggggagggggccacgccggggaaggtttgtgggccccgtccacctgcccactcgtcaaggggg

SEQ ID NO: 82604 - DNA, 201 bp, Homo sapiens
gggccctgagggaactacctgcttctcacatccccgggtctctgaccatctgctgtgtgccccgaccccccctaccctgctcctccaccaagcctgatgcyaagggctataaaccactggcccaacagaagcttggttcccagagaactggtccctgcctgggacatgctccttgctacagccccttgtgggagctcagag

SEQ ID NO: 82605 - DNA, 201 bp, Homo sapiens
ccacgccggggaaggtttgtgggccccgtccacctgcccactcgtcaagggggctgagagccagtcttggagcaggcactggtgggggaagggctgcctgraagctgacctgtcaacagcccacaagccaaacacctcggtgggcaggcagggccaaaggtgtgtggacacacgggcgctggccaggggctgggctgtggg

SEQ ID NO: 82606 - DNA, 201 bp, Homo sapiens
agtgatcctgaggggtggacggatgagaagcttatctctaagtggccagccctgggcggtggcggcaaaggcgggggaggctggcgtcccctggggtgggygccgacccacggcttggtgtagccacagcgagggactcagctagtgagaagaatgctctggaaacgcagagtggattctcggcttcaggggagggggttg

SEQ ID NO: 82607 - DNA, 201 bp, Homo sapiens
ctcacagaccactgggctctgcgggggcgtttctgcagggcagccctgggtgtgggtccttagcccaagacactttcaggcggcactgctgggagccgccrtctcctctgctggtgctcccaggcctgagaccctgacacaggccccaggccctgtccacctgctgagcaccatccctgcacaggctgccctcctgggagg

SEQ ID NO: 82608 - DNA, 201 bp, Homo sapiens
ctggggccccacccctcagcattcccccaacatctaggacacagcgtggctggaaggcagggcctaggctgggcgggggcctgccggggtgggcctccggygtctgacccttggggcctccgtttccctgtggcaagcgaagtttctctggccctccccggccagctcagtgagggacggaggagaaccacagcacccacc

SEQ ID NO: 82609 - DNA, 201 bp, Homo sapiens
ctgtgcccttccattcgcaccctgcctgcaacctcacagaccactgggctctgcgggggcgtttctgcagggcagccctgggtgtgggtccttagcccaaracactttcaggcggcactgctgggagccgccatctcctctgctggtgctcccaggcctgagaccctgacacaggccccaggccctgtccacctgctgagc

SEQ ID NO: 82610 - DNA, 201 bp, Homo sapiens
ctgggtgtttgggaatgacttcccatcgcccgcttctgcagcctgctcagccctgttggggtgcagtgtgtccactgcctgcctgtgtgtgccgctgtgcycaggctctcctcttgctcctttcaggcgcacggcggccctacaggagggtctgaggcgggcagtctctgtgccgctgacgctggcggagacggtggcctc

SEQ ID NO: 82611 - DNA, 201 bp, Homo sapiens
tgtctgacccttggggcctccgtttccctgtggcaagcgaagtttctctggccctccccggccagctcagtgagggacggaggagaaccacagcacccacscaggcacaggctcctccccgtccagctggggaatgcaagtgccaggagagactggcagggccaggcaggatgagcttcctagtccaggctggggaacgct

SEQ ID NO: 82612 - DNA, 201 bp, Homo sapiens
tgtgtggactgggggctgcccaggccggagaggacagagggtccgagaaccccgtggagctcccacccgctcccacacctggcctcctgcccggcctcgcygtctctctgcaggagagcacccccgcatgggggccctagacgtctgccccttcatccccgtgaggggcgtcagcgtggatgagtgtgtgctctgcgccca

SEQ ID NO: 82613 - DNA, 201 bp, Homo sapiens
aggcctttaaaatgcccggcatcttcctggggttttctgcggaaggaggctttgccttgtggcttgctggttctatgccacggggaggcactctccacccygcccggctgctgtccgtctctgtggggtggggtgggggtcgcatagccaacgtgttctgaatgggtttcccagaatgaattctaatcttaaatgggactg

SEQ ID NO: 82614 - DNA, 201 bp, Homo sapiens
ggggcagtggtgctggggggcggcgaagcatgagcagcagtttgctgaggggtccccagggggcaactcctttctctgggcctcaggttccccaagggcamctcagggtgatggctgtttccagaagcctgtacggggtgcctgctggggcggggcccacagggctcctggcggggcagaggtggggggtgccagccacgc

SEQ ID NO: 82615 - DNA, 201 bp, Homo sapiens
gctggggggcggcgaagcatgagcagcagtttgctgaggggtccccagggggcaactcctttctctgggcctcaggttccccaagggcaactcagggtgayggctgtttccagaagcctgtacggggtgcctgctggggcggggcccacagggctcctggcggggcagaggtggggggtgccagccacgcccctgccctgc

SEQ ID NO: 82616 - DNA, 201 bp, Homo sapiens
tctggcctgagggggccccaggccggaaggtgggggacagaagtccaggggagtgagtgccaggctctgaaggaccctggcccacatccaagggcaaggtytggggtggccgtggcaaaacaggatcctcagggctgctgtggagggcctcaggccgggctcggaaggagggggagagccgagggtctggggaggtttgga

SEQ ID NO: 82617 - DNA, 201 bp, Homo sapiens
tgcctctcttttggcattgttgatgctcttgagagcatcagccgggacattcatgcacaccattatggcagcacatggcagaaagagctatctgcttatgyatgagattgagaggtgaagccagctggacttcctgggtggagtggggacttggagaaattttctgtctagccagaggattataaatgcaccaatcagcgc

SEQ ID NO: 82618 - DNA, 201 bp, Homo sapiens
cagcacatggcagaaagagctatctgcttatgtatgagattgagaggtgaagccagctggacttcctgggtggagtggggacttggagaaattttctgtcyagccagaggattataaatgcaccaatcagcgctctgtgtctagctgaagaattgtaaatgcaccaatcagcactctgtaaaaatgcaccaatcagtgctc

SEQ ID NO: 82619 - DNA, 201 bp, Homo sapiens
attataaatgcaccaatcagcgctctgtgtctagctgaagaattgtaaatgcaccaatcagcactctgtaaaaatgcaccaatcagtgctctgtgtctagmtagaggattgtaaatgcaccaatcagcactctgtaaaatggaccaatcagcactctgtaaaatggaccaatcagcaggatgtgggcggggacaaataagg

SEQ ID NO: 82620 - DNA, 201 bp, Homo sapiens
acacgactataaggggcatgcctcggtgggcccacccagtggatcccaggccccgccttccatgaccttcgggcctttgcaccacagatctagccgcgcgrtcttcccgcctctgccgggccaactatcaagccccgccccccactgcctatcaagccccgccccccactgcccagcccacttctgcagctcacccggccg

SEQ ID NO: 82621 - DNA, 201 bp, Homo sapiens
ggattgtaaatgcaccaatcagcactctgtaaaatggaccaatcagcactctgtaaaatggaccaatcagcaggatgtgggcggggacaaataagggactraaagctggccgccactgccacccttcatccccagccagcagccggcaacctgcttgggtgcccttcggtgctgtggaagctttgtcctttcgctcttccc

SEQ ID NO: 82622 - DNA, 201 bp, Homo sapiens
tgaaagctaacactgtcctagtaggtacttttttttttttttttttttgagtcagagtctcattctgtcgcctggctggagtgcagtggcgcgatctcggstcactgcaacctccgcctcccaggttcaagtgattctcctgcgtcagcctcccgagtagctaggattacaggcatgcaccaccacacctgggtaattttt

SEQ ID NO: 82623 - DNA, 201 bp, Homo sapiens
cttcaccagtgtaactatgcttcatcaccacagttagaaaccagacgacgacattataagaacctggtgtttgcctctcttttggcattgttgatgctctygagagcatcagccgggacattcatgcacaccattatggcagcacatggcagaaagagctatctgcttatgtatgagattgagaggtgaagccagctggac

SEQ ID NO: 82624 - DNA, 201 bp, Homo sapiens
tacaggtgcccgccactatgtgcccagctaaatttttttttttttttttgagacagaattttgctcttgttccccaggctggagtgcagtggcgccatctyggttcactgcaacctccgcctccgggttcaagcaattttcctgcttcagcctcccgagtagctgggattacagacatgagaatcatgcctggctaagttt

SEQ ID NO: 82625 - DNA, 201 bp, Homo sapiens
tatgactgtttccccctctttagaacaggacagttattctctatctcatttgagaccttacaagaatttaggatgagtgagagggttctgggtctgctgcygatgtgccacgtgcccctagggtcatccctatcccagactgggcttgtttcccgagctgtaccatgatgcaaaggcagcctctctctgaagcttcttcca

SEQ ID NO: 82626 - DNA, 201 bp, Homo sapiens
agtgagtccggatcatgccactggacatgagagtgtccagcctggacaatgagagtgaaactccgtctcaaaaaaaaaaaaaaaaaatcagctgggcgtgrtggtgcatgcctgtagtcccagctactcaggaggctgaggtgggaggattgcttgagcctgggaggttcaggctgtgattgagccactgcactccagcct

SEQ ID NO: 82627 - DNA, 201 bp, Homo sapiens
agcaagaccccgtaatctactgaataaacaaacagcgcaaacagggattccctagggttcggttttcctatctctttttttctacaaccaaattggtttaytacaggaatgcaaggtttaacatatgaaaatcagttcacatattttaccacatttaataaaataaaggagaaaaaccacatgatcatctcaatagatgca

SEQ ID NO: 82628 - DNA, 201 bp, Homo sapiens
cccatcctcccccaaccaggaaattcccgttcggagtccctgtcttgctatgtgactttgaccatcacagcccgcctctgagctttttgtcagctctgtcygacaaaagggtgtagaatggttgggtgccggtggtgcacgcctgtaatcccagcactttgggaggccaaggcaggaggattgcttgagcccaggagttca

SEQ ID NO: 82629 - DNA, 201 bp, Homo sapiens
ctggtgtctctaggcctgagtctccccacctgtatacacagttcccccttctgcccacaagggtccagcatttccttcagaccttgggaactgctgatccrgggataactcacagcccgacccaactcagggataaggaagtatggctttggggatgtgactggaataaacgtgaaggactcctgacctatcccattttat

SEQ ID NO: 82630 - DNA, 201 bp, Homo sapiens
ccttgggaactgctgatccggggataactcacagcccgacccaactcagggataaggaagtatggctttggggatgtgactggaataaacgtgaaggactyctgacctatcccattttatccccctccagacctgcgggggatgacagctgaaccgcctaaaggaggtgagtttgaaggaagaggtccctagctctgttcc

SEQ ID NO: 82631 - DNA, 201 bp, Homo sapiens
ccaggagacgcagagaggagtcaggatcgttgaaaaccaataatttatcaaaacgctgcgtgtgtatgtgggggggagggtgtcgcaacagacagggcagyggtgggcggacgcacaggcaggagacggtgcccggagagtgggggcggcagcttgccactggctggccatgcgggcgggcaggctagacattcttgccgc

SEQ ID NO: 82632 - DNA, 201 bp, Homo sapiens
ggggggaccacccttctggccatccttcagaatgctagctgcccttcacagataaggaaactgagtcacagagcagaggagccatttgtttcaagccccayggcttagtaagtgcaggctaggccgcatgggacccaggcccccagttctgggtgttggcaaagccttttccccactctggagtgagtgggttgtgcctat

SEQ ID NO: 82633 - DNA, 201 bp, Homo sapiens
ctctccctctccaaaccagatctattgggaagcctgtctctctagctcttaagctattccagtcatctagtccatcccatctctcatccaagcctcatccraggaaggtcctagaatgctatatccatcccttctctgtttggaaaccctttataactcctgttgtcctcaggaggaaggtcaaacttttttttttttttt

SEQ ID NO: 82634 - DNA, 201 bp, Homo sapiens
aacgctgcgtgtgtatgtgggggggagggtgtcgcaacagacagggcagcggtgggcggacgcacaggcaggagacggtgcccggagagtgggggcggcascttgccactggctggccatgcgggcgggcaggctagacattcttgccgcgcaggcgcagttcgtggcgtcgcaggtggttgtagagcgactgcacatagg

SEQ ID NO: 82635 - DNA, 201 bp, Homo sapiens
ttagaatggtctcacctgctgggccctgaactgccagaagacagggctatgtctggctcctctggcttgactaaatgccccccttacttcccccacccgcmtccctggaccctctctggccttgctgagcagattctggtgaaacggggcaggtgggagaggcggcgtttctcaccgtggggccccgagcaggggttagga

SEQ ID NO: 82636 - DNA, 201 bp, Homo sapiens
cttctgtcagctttcttctctccagtattcactgggtgtggtttgggaggggaacttgctcaaggtcacctggtgaactgagaaggtctcctgtgtttcartgagaaaacttagtgacctaggatgagcacaagcccttcgagctatctgggggaagggaacttgggtggagaagggcccagcagtggggtaacagactga

SEQ ID NO: 82637 - DNA, 201 bp, Homo sapiens
ctgcccctcagcccccagggtgctctcttcacctagcccctgctcgctgagcagaggaaagtaccagcccctcagtcaggagcaccagggagcctgcagtrtatgtggggggggtgtgtggaaccagggatcaggaaagcggggggcactgggtctcaggggtcttaccttggagggtgccccagtttgggcaacaccctg

SEQ ID NO: 82638 - DNA, 201 bp, Homo sapiens
acagcaagctctccataaaggtggctgctctgtatttatcatcatcatcatcaccaccattgacttcagcctgcccatgtggtggatgctgaaacaggctragggtggttactctcctgggaggacaaggaaggggctctgagacccaagcctggtcttgtcaggagaagggggtagggggcggaccccagctgaaaaggg

SEQ ID NO: 82639 - DNA, 201 bp, Homo sapiens
gggagtcctggggcggagaccgagcgctgggggcgtggtctccagcgggactgggcctctagcgggagtgggggccggggcgggggcggggccagcctggrggcccagacgtggcgcagcgactcggaggttcgcctccagcttgcgcatcatctgcggccgggtcccgatgagcctcctgttgcctccgctggcgctgct

SEQ ID NO: 82640 - DNA, 201 bp, Homo sapiens
agctagcgggaggtaacggcggggagtcctggggcggagaccgagcgctgggggcgtggtctccagcgggactgggcctctagcgggagtgggggccgggscgggggcggggccagcctggaggcccagacgtggcgcagcgactcggaggttcgcctccagcttgcgcatcatctgcggccgggtcccgatgagcctcct

SEQ ID NO: 82641 - DNA, 201 bp, Homo sapiens
cctgagctagcgggaggtaacggcggggagtcctggggcggagaccgagcgctgggggcgtggtctccagcgggactgggcctctagcgggagtgggggcsggggcgggggcggggccagcctggaggcccagacgtggcgcagcgactcggaggttcgcctccagcttgcgcatcatctgcggccgggtcccgatgagcc

SEQ ID NO: 82642 - DNA, 201 bp, Homo sapiens
gatagccacattaaaaaaaaaagtaaatcctgactccataaatttaacccagctgatttaagaccctgttgtggcctatcagctgtaaccctccttgcatyttcccacctttgaatagcaaattcctttcctcaccccaggtcagaaagtctgctcagcagtagctgtggatggtaagaagacacgctggtaggtctcagt

SEQ ID NO: 82643 - DNA, 201 bp, Homo sapiens
tgctcttgagagcatcagccgggacattcatgcacaccattatggcagcacatggcagaaagagctatctgcttatgtatgagattgagaggtgaagccarctggacttcctgggtggagtggggacttggagaaattttctgtctagccagaggattataaatgcaccaatcagcgctctgtgtctagctgaagaattgt

SEQ ID NO: 82644 - DNA, 201 bp, Homo sapiens
taaaaaaaaaaagaaaaaagaggccaggcacagtggctcatgcctgtaaccccagcattttgggaggcggaggcgggcggatcacttgaggttgagaccarcctaacatggtgaaatcctgtctctactaaaaataaaaaaaattatccgggcatgatggcacgctcctgtaatcccagctacacaggaggctgagacacg

SEQ ID NO: 82645 - DNA, 201 bp, Homo sapiens
cgaagctggtggatcgctgcacggctgcgcggggtccgccagggctgctgtaggggcggtgtcaggaccaggtcacacgactataaggggcatgcctcggwgggcccacccagtggatcccaggccccgccttccatgaccttcgggcctttgcaccacagatctagccgcgcggtcttcccgcctctgccgggccaacta

SEQ ID NO: 82646 - DNA, 201 bp, Homo sapiens
ggcatgagccactgggcccagcccctttatttttattattttttgacacagggtcttactcacattgcccaggctagagtgcagtggtacgatcttggctyactgtattattttttattttttataggagatggggtctcactctgtctcccaggttagagtgcagtggcatgatcatagctcactgtagtcttgaactcc

SEQ ID NO: 82647 - DNA, 201 bp, Homo sapiens
ggatcaaacttcacctgaagccccacctgccattggactttttttttcttctttttgaaatggagtctcaatctgtcgcccaggctggagtacagtggcaygatcttggctcactgcaacctccgccacccaggttcaagcgattctcctgcctcagcctcccgagtagctggagttacaggtgcccaccgctgcgtttgg

SEQ ID NO: 82648 - DNA, 201 bp, Homo sapiens
gagtctcgctctgtcacccaggctggagtgcagtggcatgatttcagctcattgcaaccttcgcctcctgggttcaagtgattctcctacctcagcctccygagtcgctaggattacaggtgtgcgccacacgcctggctaatttttgtatttttagtagagatggggtttcaccatgttggtcaggctggtctcgaactc

SEQ ID NO: 82649 - DNA, 201 bp, Homo sapiens
tgctgagcagattctggtgaaacggggcaggtgggagaggcggcgtttctcaccgtggggccccgagcaggggttaggactttttggtttttaccagcccyttctggaccagacagcggtagaattcctggatgtacgtgtacacgcacttccagtcaggctctcgaagccgcaccatgtcctctgtatccaggagctgcg

SEQ ID NO: 82650 - DNA, 201 bp, Homo sapiens
cgtccaggctggagtgcagtggcatgatctcagctcactgaaacctccacctctggtccaagcaattctcctgcctcagcctcccgagtagctgggattayagacatgcaccaccatgcccagctaattttgtatttttagtagagacagggttttgccttgttgaccaggctggtcttgaactcctggactcaagtgatc

SEQ ID NO: 82651 - DNA, 201 bp, Homo sapiens
agtgctgggattacaggcgtgagccaccaagactgggcctatacatgttttatagaattggttggttactgtgttgctgccacaatgtccagcaacacagyagggttagggttagggttaggatcctgttaaggttgcagcccatctccttcttaacaggaactggaatatggtggaccccaccctcagcttcaggaatgg

SEQ ID NO: 82652 - DNA, 201 bp, Homo sapiens
tataatatgcatatatatttatatacatgtatatttacatatacgtgttatatattttatatagctatatctattttttgagatggagtctcactctgtcktccaggctggagtgcagtggcatgatctcagctcactgaaacctccacctctggtccaagcaattctcctgcctcagcctcccgagtagctgggattaca

SEQ ID NO: 82653 - DNA, 201 bp, Homo sapiens
tcttgcccatgatcatcatgtcgtccacctccaccaggggcacacagtccaccagcatcctgcagggagggggcacggggttggatgtcagcgccagaccygcctctcgtggcgcccctctaccccaaggtcttttttattgccgcattgcctgctggtctttcataaactccagacagggaaaagccttccaggaaggca

SEQ ID NO: 82654 - DNA, 201 bp, Homo sapiens
tgagacccaagcctggtcttgtcaggagaagggggtagggggcggaccccagctgaaaagggagtgagttggagctatatttgagctcctggtgtgatgaytaaggaggttgataacaggctctggggctcagggcggcaggctgggggcagctgtcagggagaaccgcccccctggagacggctgtctctggaggccctt

SEQ ID NO: 82655 - DNA, 201 bp, Homo sapiens
tgcccaccaccccgctccttaacaccacctccagtcacaacctggtgatgaaacacctccctggggccgaccctgagctcgtgctgctgggccgccgctasgaggaactagaggtgaggccgtgggaggtgggctgggggcgaggccagaggcgaggcccagcctgctgaccccgcccctcctccgcctcagcgcatccca

SEQ ID NO: 82656 - DNA, 201 bp, Homo sapiens
gatcgttgaaaaccaataatttatcaaaacgctgcgtgtgtatgtgggggggagggtgtcgcaacagacagggcagcggtgggcggacgcacaggcaggaracggtgcccggagagtgggggcggcagcttgccactggctggccatgcgggcgggcaggctagacattcttgccgcgcaggcgcagttcgtggcgtcgca

SEQ ID NO: 82657 - DNA, 201 bp, Homo sapiens
gtttaacatatgaaaatcagttcacatattttaccacatttaataaaataaaggagaaaaaccacatgatcatctcaatagatgcaggaaaacatttgacraagttcaacatccattcatgataaaagctctaagaaaaatagaaatagaaaactttcttttacaaaaggcaccagtaacaaacctacagcaaacatgatc

SEQ ID NO: 82658 - DNA, 201 bp, Homo sapiens
ctttcccaaggtcacacagctggggctgagctcaggcctctctcctccttctcttcggctccccctcctcctaggcagcccagcacccgctgtcagctgckctgaagtgagtggctatttttattctggtgcgaggggatctcaagcagcagagccatgtaggttagaggctctaggacacccggcctcagcagtccaggg

SEQ ID NO: 82659 - DNA, 201 bp, Homo sapiens
caagggacagagctactgagaggcccagcgccacccagctaaggctatggtcatgcctcatcactccttccctcatttagagaaattgactcagggcctcmtacagagcaacaaggaggggactccaagagtgggatccggccttgaaccctgcccaccacccaagaggccctgttacttcatcactgattctggaatcta

SEQ ID NO: 82660 - DNA, 201 bp, Homo sapiens
gaagacctatagaaatggagggacttactatgttcgtggaagaaaagtcacaataatgtaaagctgtagagtctccccacattgatttccccagtgggaayctgaaatcctgatagaaatttggaaggtttttctgtggaggttgacgagctggccctaaattgtacctggaagtgtgaaaggccaagtatagtcaagaca

SEQ ID NO: 82661 - DNA, 201 bp, Homo sapiens
gctgggggcgaggccagaggcgaggcccagcctgctgaccccgcccctcctccgcctcagcgcatcccactcagtgaaatgacccgcgaagagatcaatgmgctagtgcaggagctcggcttctaccgcaaggcggcgcccgacgcgcaggtgccccccgagtacgtgtgggcgcccgcgaagcccccagaggaaacttcg

SEQ ID NO: 82662 - DNA, 201 bp, Homo sapiens
ccctattctttgacagggggtggggataaccctgctgctggagatggaggccagggaacgtgtgggcagcagaggggttctctaacccttatcacctgccwtgggtagagcagaggaggcagatgaggatcccagccaataccaatggaccatctatgccatgctcggggggaccacccttctggccatccttcagaatgc

SEQ ID NO: 82663 - DNA, 201 bp, Homo sapiens
ctcctctggcttgactaaatgccccccttacttcccccacccgcctccctggaccctctctggccttgctgagcagattctggtgaaacggggcaggtggkagaggcggcgtttctcaccgtggggccccgagcaggggttaggactttttggtttttaccagccccttctggaccagacagcggtagaattcctggatgt

SEQ ID NO: 82664 - DNA, 201 bp, Homo sapiens
ctgaaccgcctaaaggaggtgagtttgaaggaagaggtccctagctctgttccccctgagcctcttggggagtgggcaacatggtcccaatgactggggcrgggaggggggaaggatccctaggctgagagtctagcctaggctgagagtctagcctgcacctgacttgctttatgacctcactgggcttcagtgtctcgt

SEQ ID NO: 82665 - DNA, 201 bp, Homo sapiens
gccttccatgaccttcgggcctttgcaccacagatctagccgcgcggtcttcccgcctctgccgggccaactatcaagccccgccccccactgcctatcamgccccgccccccactgcccagcccacttctgcagctcacccggccgcgccctccttctccagcttctcaatcatggccttgcgcgcctgggaggctgagg

SEQ ID NO: 82666 - DNA, 201 bp, Homo sapiens
ctgggaggtggaggtggaggttgcaatgagccaagatcgtaccactgcactccagcctgggtgacagagagaggccctgtctcaaaaaaaaaaaaaaaaaraaagaaagaaaagaaaaaagaaaaagaaaatgggagcccccaagactacccagcttttcatgcaatcctagagggaatgatgggcagatccaggcctctg

SEQ ID NO: 82667 - DNA, 201 bp, Homo sapiens
ccagtcaggctctcgaagccgcaccatgtcctctgtatccaggagctgcgggcagtccgcatgggtcctggggagggtagggggccgggaaggggtggggkacgggggcaggaggccagggccccgggtggggaagagagggaagaggcagagaagagagaggggaggaaacagagacacacacacatacacacacacaca

SEQ ID NO: 82668 - DNA, 201 bp, Homo sapiens
gtggccgtggcaaaacaggatcctcagggctgctgtggagggcctcaggccgggctcggaaggagggggagagccgagggtctggggaggtttggatgcarggtggggagcctgtaggaccagatgtctgagctggaggctggagatgcccctcagaagcagggagaggtctaggggctggggcatccctctttctagctg

SEQ ID NO: 82669 - DNA, 201 bp, Homo sapiens
ggggctctgagacccaagcctggtcttgtcaggagaagggggtagggggcggaccccagctgaaaagggagtgagttggagctatatttgagctcctggtrtgatgactaaggaggttgataacaggctctggggctcagggcggcaggctgggggcagctgtcagggagaaccgcccccctggagacggctgtctctgga

SEQ ID NO: 82670 - DNA, 201 bp, Homo sapiens
tcccaaagtgctgggattacaggcatgagccaccatgcccgtcctgtattaggtactgttctaatgagctttatatgtgttaacccctttatcctgccaaycccaacagggtacacaatattgcatcaccacaatgtgtgctctgggaagtaaaaaccttgattggaatttttgtccaaagaaataaaaaggccaggtgga

SEQ ID NO: 82671 - DNA, 201 bp, Homo sapiens
tgcagtgagtccggatcatgccactggacatgagagtgtccagcctggacaatgagagtgaaactccgtctcaaaaaaaaaaaaaaaaaatcagctgggcrtgatggtgcatgcctgtagtcccagctactcaggaggctgaggtgggaggattgcttgagcctgggaggttcaggctgtgattgagccactgcactccag

SEQ ID NO: 82672 - DNA, 201 bp, Homo sapiens
ttcattctcaccctctgaggcagatgtcatcctcactccccattctgccactcaggaaatgggctggaggaggaggagtgactttcccaaggtcacacagytggggctgagctcaggcctctctcctccttctcttcggctccccctcctcctaggcagcccagcacccgctgtcagctgctctgaagtgagtggctattt

SEQ ID NO: 82673 - DNA, 201 bp, Homo sapiens
gatgtctgagctggaggctggagatgcccctcagaagcagggagaggtctaggggctggggcatccctctttctagctgatgtctgtcccacagaggctgygcctgatgccgtggatgctggagccagggcctgttcctgagttggagacagaactggactgggcaccggggaaggggtggaggggagttctgggggctgc

SEQ ID NO: 82674 - DNA, 201 bp, Homo sapiens
cctgacatcccaggtctgggcacactggggacagcctgtttcttttctttttctattgtcaagatacagacctacaggtgcagcttgttaaatacctctcycttccttcataatgcccagaaaccctcagttccccaccgccccctaaacatccaaatcccttggttacagccctctctgttctcttacccattcccagag

SEQ ID NO: 82675 - DNA, 201 bp, Homo sapiens
cagccatttcaacctgctgagaatttaaaggcacaggctcccacttcccagcctggaagaggccgaagcaaggtggctaccccctgggaatccttcaaacwggctgctgaggctggaacagccatggagtggggaggggagagtgtacccatctgcctggcccaggtcccaactggcagcaggaaggaggctgtctgtcta

SEQ ID NO: 82676 - DNA, 201 bp, Homo sapiens
tcctagagggaatgatgggcagatccaggcctctgggaccagtcctaaggctcagccatctagggctgggacaggggcatcagtgccctttggaagccagrcaaatgtcatgcaaatgtgtctgcagagggctcctctgcctcaggagggcaacccaggatttcccaccacccgctccctgagctcagaccctgcagggga

SEQ ID NO: 82677 - DNA, 201 bp, Homo sapiens
agaatgaaccctgactctagtcacatactgatctaagcctgaattaggctgatcccaacttgagaccttagttctgggcccagatcaagcccttatccttytctaagactgagccttagtcacagactgaattctagccccagcccagactaaccttttagactgactctggcagaagagtcagactaaccttttaaccct

SEQ ID NO: 82678 - DNA, 201 bp, Homo sapiens
gctggcaggcacactgtgggtctctggccttgctcttttcccctggtgtctctaggcctgagtctccccacctgtatacacagttcccccttctgcccacragggtccagcatttccttcagaccttgggaactgctgatccggggataactcacagcccgacccaactcagggataaggaagtatggctttggggatgtg

SEQ ID NO: 82679 - DNA, 201 bp, Homo sapiens
cctgactccataaatttaacccagctgatttaagaccctgttgtggcctatcagctgtaaccctccttgcatcttcccacctttgaatagcaaattccttkcctcaccccaggtcagaaagtctgctcagcagtagctgtggatggtaagaagacacgctggtaggtctcagtggctcccagaagccgcaccccctccacc

SEQ ID NO: 82680 - DNA, 201 bp, Homo sapiens
tcatctacccaagcctggaggcatctctcggggcgggggagcagagctaggcaggtggaggcggagatggcagaagagagccccatcccagtcaggcaggkcctgggtctgcttcctccaaccctggggaggtgctggctccaaaccctgcccatgttctccctggagaccaccttctgctcaccctcactggcacactcc

SEQ ID NO: 82681 - DNA, 201 bp, Homo sapiens
ggaggttgcagtgagctgagatcgtgccactgcactccagcctggctgacagagcaagactctgtctcaaaaaaacaaacaaacaaaaaaacaaaaaaaaatgggccaggcgcagtggctcacacctgttatcccagcactttgggaggctgagacgggcggatcatgagatcaggagatcaagaacatcctggctaacac

SEQ ID NO: 82682 - DNA, 201 bp, Homo sapiens
acctgcaaaatggagttcacggggtctttatgaggtaaggaaggaactgataatgaaagctaacactgtcctagtaggtacttttttttttttttttttttgagtcagagtctcattctgtcgcctggctggagtgcagtggcgcgatctcggctcactgcaacctccgcctcccaggttcaagtgattctcctgcgtcag

SEQ ID NO: 82683 - DNA, 201 bp, Homo sapiens
ctgggagggcttccctgaggaggaagtatacagggcacaaaagagcatttcttctcccaaggcttcactccagggtttcttgttggtaacaagcttcacakgttatgtccccagcacttcattctcaccctctgaggcagatgtcatcctcactccccattctgccactcaggaaatgggctggaggaggaggagtgactt

SEQ ID NO: 82684 - DNA, 201 bp, Homo sapiens
tctgttccccctgagcctcttggggagtgggcaacatggtcccaatgactggggcggggaggggggaaggatccctaggctgagagtctagcctaggctgrgagtctagcctgcacctgacttgctttatgacctcactgggcttcagtgtctcgtctgtacctcgagtagactgaggtcatggtctctgatgctctggtt

SEQ ID NO: 82685 - DNA, 201 bp, Homo sapiens
cagcactctgtaaaatggaccaatcagcaggatgtgggcggggacaaataagggactaaaagctggccgccactgccacccttcatccccagccagcagcyggcaacctgcttgggtgcccttcggtgctgtggaagctttgtcctttcgctcttcccaataaatcttgctgctgctcactctttgggtcctcaccacctt

SEQ ID NO: 82686 - DNA, 201 bp, Homo sapiens
cagtgacgaacttgctgtgtctgtggaagaaagcatgaagaagagaactggcatcctaatctggtgatctggtgatccgttctccttttttttttttttttaattgtaggcattttatctgcaaatgcatattacctccttagaaaaagaattccaggattttacctcctgtgtgttttcgtcttgcttctttgtgatcca

SEQ ID NO: 82687 - DNA, 201 bp, Homo sapiens
atcccagctactcaggaggctaaggcaggagcattgtttgaggccaggagttgaacactagctgggacaacacagaaagaccctgtctctaaaaaaaaaaagaaaaaagaggccaggcacagtggctcatgcctgtaaccccagcattttgggaggcggaggcgggcggatcacttgaggttgagaccagcctaacatggt

SEQ ID NO: 82688 - DNA, 201 bp, Homo sapiens
gactgtgccctgaatctggtcacagactgagccctgaacttagtcattgacagagacatgaccctggtcacagactgagcctggctcctggtcacagactraagactaagcccaatcatggactgagccctgtatctagccctaggctacagactactcaactaagggctgacctagaccctgtctgagcctgaccccatc

SEQ ID NO: 82689 - DNA, 201 bp, Homo sapiens
tttttttttttttgagacggagtctcgctctgtcacccatgctggatggagtgcagtggcgtgatctcggctcactgcaagctccgcctcccgggttcacsccattctcctgcctcagcctcccgagtagctgggactacaggtgcccgccaccacgcctggctaatttttcgtatttttagtagagacgggggggtttca

SEQ ID NO: 82690 - DNA, 201 bp, Homo sapiens
ctgtatctagccctaggctacagactactcaactaagggctgacctagaccctgtctgagcctgaccccatcacagactaatccccaaccttggccccacytgaggaagactgctggcctaaattacatgctgccacataagaggcatggattatgggcagagatctgtcttgggagatcttgggcttctcatgctgctga

SEQ ID NO: 82691 - DNA, 201 bp, Homo sapiens
gactcagtgcagacttaacttctctagaaggcacagtaggctcagtgtttagggcccactatacttttagggggtccatgaaagtgtttttttttttttttgagacggagtctcgctctgtcacccatgctggatggagtgcagtggcgtgatctcggctcactgcaagctccgcctcccgggttcacgccattctcctgc

SEQ ID NO: 82692 - DNA, 201 bp, Homo sapiens
tcatacttccccagcagtgaacagagtgttagagatagcttactgtgtgaatagtctggacaagactaatcatattgactacatactcatattatatatawatatttttttttttttttttttttgagacggagtcttgctctatcacccaggctggagtgcagtggcacaatcttggctcactgcagcctctgcctcccg

SEQ ID NO: 82693 - DNA, 201 bp, Homo sapiens
gcttcaccatattggccaggctgctctcaaactcctgacctcaggtgatccgcccacctcggcctcccaaagtgccgggattacaggcgtgagccacccaygcccagcctgctgcatcatttttaacaattgcatggttttccatcctatggaggtacactcattaatttaactcatcccctgctgtgacatgcttaggtt

SEQ ID NO: 82694 - DNA, 201 bp, Homo sapiens
ttgagacagtctcactgtgtcgcccaggccggagtgcagtggtgcgatctcggctcactgcaacctccacctcccgggttgaagcgattctcctgcctcarcctctggagtaactgggactacaggtgcccgccactatgtgcccagctaaatttttttttttttttttgagacagaattttgctcttgttccccaggctg

SEQ ID NO: 82695 - DNA, 201 bp, Homo sapiens
cacagactgagcctggctcctggtcacagactaaagactaagcccaatcatggactgagccctgtatctagccctaggctacagactactcaactaagggstgacctagaccctgtctgagcctgaccccatcacagactaatccccaaccttggccccacttgaggaagactgctggcctaaattacatgctgccacata

SEQ ID NO: 82696 - DNA, 201 bp, Homo sapiens
cttcaacctgggggcgacagagcgagactccgtctcaaaaaaaaaaaaaagaaagaaagaaagaaaagaaaaatagaaaaaagagagttgtatcactcacygtgaaagtccgtggcttcattcttgaagtcagtgagaccactaacccactggaaggaagaaactccagacacatttgaaggaacaaactctggacacacc

SEQ ID NO: 82697 - DNA, 201 bp, Homo sapiens
atgatgataccaatactgatgatggtgttgtgtcaatgaaagaggtagtgttggagttggaggtgacagtcagggaggatgtgagagtagacctggtggtratgctcaggttaccagaaaaaggaagattcgaactcatcctgtcttatcctctgtctcctgttttacaaataagaaaatgggagcccccgggctggggga

SEQ ID NO: 82698 - DNA, 201 bp, Homo sapiens
aggatgacagggtggatgtagaagaggaggtggtgactggggctggggcttcttgggcctgaaggttggggctcaggcacctgccaggccctgtactctgkgtgccaagccttgggagggccatgtcaggggctgggggaacacagggagagcgattcggggagtggcttggggaacggctgggtgatcggggtggcttgg

SEQ ID NO: 82699 - DNA, 201 bp, Homo sapiens
ccagcccgggtccctggcctcctgctgcccctgctgctctggccctccatgtctgcagcccccggcagcctggactcccttggctccggctccagctctaycgctcccgggaaccagtgatgtcatcagccatttcaacctgctgagaatttaaaggcacaggctcccacttcccagcctggaagaggccgaagcaaggtg

SEQ ID NO: 82700 - DNA, 201 bp, Homo sapiens
ctttatgaggtaaggaaggaactgataatgaaagctaacactgtcctagtaggtacttttttttttttttttttttgagtcagagtctcattctgtcgcctggctggagtgcagtggcgcgatctcggctcactgcaacctccgcctcccaggttcaagtgattctcctgcgtcagcctcccgagtagctaggattacagg

SEQ ID NO: 82701 - DNA, 201 bp, Homo sapiens
tttcaagggacagagctactgagaggcccagcgccacccagctaaggctatggtcatgcctcatcactccttccctcatttagagaaattgactcagggcytcctacagagcaacaaggaggggactccaagagtgggatccggccttgaaccctgcccaccacccaagaggccctgttacttcatcactgattctggaat

SEQ ID NO: 82702 - DNA, 201 bp, Homo sapiens
ctactgcttaagaggagcagggtgatcatttcccctgggcattgggagtcagtccacagccagtaggatgtacaggccccaaggctggcaggcacactgtkggtctctggccttgctcttttcccctggtgtctctaggcctgagtctccccacctgtatacacagttcccccttctgcccacaagggtccagcatttcct

SEQ ID NO: 82703 - DNA, 201 bp, Homo sapiens
ggcagagtgtgaacctaaacctgaggacttgccttgccttcctggctggcacccacaccctgcccattcggggcagcttccctgggcaaccctcccactgyagtccctgaagctcccccagccacggctactgacctgacatcccaggtctgggcacactggggacagcctgtttcttttctttttctattgtcaagatac

SEQ ID NO: 82704 - DNA, 201 bp, Homo sapiens
aggaggtggagattgcagtgagccaagattgtgccactgcactccagcctgggcgacagagcaagactccgtctcaaaataaaaataaaaattaaaaaaaraaaaaagaaagaaaaccctaggatccatgaaagtcataatgcagccttggctcggtattgagaaggagtccctagattcaatgggaaaagaggacagtga

SEQ ID NO: 82705 - DNA, 201 bp, Homo sapiens
gagtgggcaacatggtcccaatgactggggcggggaggggggaaggatccctaggctgagagtctagcctaggctgagagtctagcctgcacctgacttgytttatgacctcactgggcttcagtgtctcgtctgtacctcgagtagactgaggtcatggtctctgatgctctggttcctccccaggtgaaggctttcgtc

SEQ ID NO: 82706 - DNA, 201 bp, Homo sapiens
gatcctggtgtcacatctctctgtgcccaggttgtgccctcttacatcctccactttctcccctacctgaaaggacaggcaagcaggtatcccatttatgwccggcaggtgggaggggtggggagtcacggagtcctgtagagacctatcctccttccccatctattctctctgatgtcccctgtctccagaagacaggat

SEQ ID NO: 82707 - DNA, 201 bp, Homo sapiens
gatatcaagtggtggagccaagaatagtgcctcgttgcatcttactccaacctctagcccatccggcctcctcccttcacgtgcgcctaagagggctaggkggcctggataggggaggtcagctccacagttttgagtaaacacacacagtctcaactctgatgacaacttaagtgccaggcatagtggctggcatggggc

SEQ ID NO: 82708 - DNA, 201 bp, Homo sapiens
aatacacgcagctgacctgggctcaaggtctggccctgccacgtgctggctctgtgatgctggccaagtgccttcgcctctccgggccacagttttttgayctgaagagtggagccctactcaagccatctgcagctctcgggctctctgacctgacatctttcgggtggtggggacacaaaggaagcagcctctattggg

SEQ ID NO: 82709 - DNA, 201 bp, Homo sapiens
acgcatctggccccctacagcgacgagctgcgccagcgcttggccgcgcgccttgaggctctcaaggagaacggcggcgccagactggccgagtaccacgscaaggccaccgagcatctgagcacgctcagcgagaaggccaagcccgcgctcgaggacctccgccaaggcctgctgcccgtgctggagagcttcaaggtc

SEQ ID NO: 82710 - DNA, 201 bp, Homo sapiens
tggcccatggaaaaattgtccaccacaaaactggtccctggtgccaaaaaggctgaggaccactgctctagccagaccttcagaaaaggaaaatggggccrggcgcagtggctcgtgcctgtaatcccagcactttgggaggccgaggcaggaggatcccctgaggtcaggaattcaagaccaacctggccaacatggtga

SEQ ID NO: 82711 - DNA, 201 bp, Homo sapiens
tccagcctaaagctccttgacaactgggacagcgtgacctccaccttcagcaagctgcgcgaacagctcggccctgtgacccaggagttctgggataaccyggaaaaggagacagagggcctgaggcaggagatgagcaaggatctggaggaggtgaaggccaaggtgcagccctacctggacgacttccagaagaagtgg

SEQ ID NO: 82712 - DNA, 201 bp, Homo sapiens
atggaaaaattgtccaccacaaaactggtccctggtgccaaaaaggctgaggaccactgctctagccagaccttcagaaaaggaaaatggggccaggcgcrgtggctcgtgcctgtaatcccagcactttgggaggccgaggcaggaggatcccctgaggtcaggaattcaagaccaacctggccaacatggtgaaacccc

SEQ ID NO: 82713 - DNA, 201 bp, Homo sapiens
gtgctcaaagacagcggcagagactatgtgtcccagtttgaaggctccgccttgggaaaacagctaaagtaaggacccagcctggggttgagggcaggggyagggggcagaggcctgtgggatgatgttgaagccagactggccgagtcctcacctaatatctgatgagctgggccccacagatggtctggatggagaaac

SEQ ID NO: 82714 - DNA, 201 bp, Homo sapiens
agaaagaaagaaagaaagaaagaaagaaagaaagaaagaaagaaatagaaagagaaagaaagggaaaggaaaggaaaatggaaatgagggctaaaacggcrcgccctaggactgctccggggagaaaggagggacctgggaggaatgcagtctcaactctgtcatctctcccgcagcagcctgacaaaggccctgtgagga

SEQ ID NO: 82715 - DNA, 201 bp, Homo sapiens
ccagcaagactgtgggctgtcttcggagaggagaatgcgctggaggcatagaagcgaggtccttcaagggcccactttggagaccaacgtaactgggcacyagtcccagctctgtctcctttttagctcctctctgtgcctcggtccagctgcacaacggggcatggcctggcggggcaggggtgttggttgagagtgtac

SEQ ID NO: 82716 - DNA, 201 bp, Homo sapiens
cacgcatctggccccctacagcgacgagctgcgccagcgcttggccgcgcgccttgaggctctcaaggagaacggcggcgccagactggccgagtaccacsccaaggccaccgagcatctgagcacgctcagcgagaaggccaagcccgcgctcgaggacctccgccaaggcctgctgcccgtgctggagagcttcaaggt

SEQ ID NO: 82717 - DNA, 201 bp, Homo sapiens
cagcctgacaaaggccctgtgaggaaagaggaggctgaagaggcacaggcccaggggaggctggagcacctccattccattgttgggatctcaccagggcwggggcgggtgggaatggaggcagctggcaggggggatggggagggaggccagcgggtgtacctggcctgctgggccacctgggactcctgcacgctgctc

SEQ ID NO: 82718 - DNA, 201 bp, Homo sapiens
tgacaaaggccctgtgaggaaagaggaggctgaagaggcacaggcccaggggaggctggagcacctccattccattgttgggatctcaccagggcaggggygggtgggaatggaggcagctggcaggggggatggggagggaggccagcgggtgtacctggcctgctgggccacctgggactcctgcacgctgctcagtgc

SEQ ID NO: 82719 - DNA, 201 bp, Homo sapiens
gagtacccggggctgcatggcacctctgttcctgcaaggaagtgtcctgtgaggggcaccccaggtccccatgcctctggacccctccctggggaggtggygtggcccctaaggtagaaccttagctgggtctgccagaaggagtaggggccggctccctgctaatacgggctctcagaagggggactggtgaggggcgag

SEQ ID NO: 82720 - DNA, 201 bp, Homo sapiens
catcctggctagattgccatcagacgcagagcatggatgaggacactgaagcctggacctgtgacgtcgcttgcccagtgaacagcaggatgggctaggcmgcgctttttagaccctgcacccctggccatccatgattattgaaaagagtgtgcgggtcgggtgcggtggctcaagcctgtaatcccagcactttgggag

SEQ ID NO: 82721 - DNA, 201 bp, Homo sapiens
ggccaaggtgcagccctacctggacgacttccagaagaagtggcaggaggagatggagctctaccgccagaaggtggagccgctgcgcgcagagctccaaragggcgcgcgccagaagctgcacgagctgcaagagaagctgagcccactgggcgaggagatgcgcgaccgcgcgcgcgcccatgtggacgcgctgcgcac

SEQ ID NO: 82722 - DNA, 201 bp, Homo sapiens
ccggctccctgctaatacgggctctcagaagggggactggtgaggggcgagggatcgaggcccaaagggaggtgggtgggatggagcagaaaacccaccaractgaacatcaaggcacctgcggtctggactgatctccgtccagtccagccaacatgctgtgtgtctttgggtgatttctggccctctccaggcctcagt

SEQ ID NO: 82723 - DNA, 201 bp, Homo sapiens
gccagaagctgcacgagctgcaagagaagctgagcccactgggcgaggagatgcgcgaccgcgcgcgcgcccatgtggacgcgctgcgcacgcatctggcsccctacagcgacgagctgcgccagcgcttggccgcgcgccttgaggctctcaaggagaacggcggcgccagactggccgagtaccacgccaaggccaccg

SEQ ID NO: 82724 - DNA, 201 bp, Homo sapiens
ctgaagccatcggtcacccagcccctaaatcagtcaggggaagcaacagagcagggcatgagaactcctctgtaggcaaccatgggacccacacccatgtmcccactggacgacaccagtcaggaccacaccaccctctcaacttcactggacgacagccctgagacctcaggcaggaatcccccacagctgccaccctgg

SEQ ID NO: 82725 - DNA, 201 bp, Homo sapiens
tcacctcagatgtttatgcccctgggcctgaggcacaaagtgacagggtggggagatgtgaaaggtcaaggctgtcattgttttctgtgcaaacagcaccrcctggagttgcacaacctggtggctctgagcagggtaggacagagggaggcagcctctcatttggaaagtcattggaggattgattagttgtgtgatctg

SEQ ID NO: 82726 - DNA, 201 bp, Homo sapiens
agggaggcatcctcggcctctgaagctcctgaggaaagagcagggctgagtggggtggatcggcctctggacgagccctgggctcctgcttgaccacccaytgggactgggatccccaagttgcctccaccctgcccccagcccagtcccaccaagtgcttacgggcagaggccaggagcgccaggagggcaacaacaagg

SEQ ID NO: 82727 - DNA, 201 bp, Homo sapiens
ccccttcccggtgctcagaataaacgtttccaaagtgggaagcagcttctttcttttgggagaatagaggggggtgcggggacatccgggggagcccgggwggggcctttggccctggagcagggacttcctgccggatctcaacaactccgtgcccagactggacgtcttagggccaagatcgacgttggaggacctgct

SEQ ID NO: 82728 - DNA, 201 bp, Homo sapiens
attgtccaccacaaaactggtccctggtgccaaaaaggctgaggaccactgctctagccagaccttcagaaaaggaaaatggggccaggcgcagtggctcrtgcctgtaatcccagcactttgggaggccgaggcaggaggatcccctgaggtcaggaattcaagaccaacctggccaacatggtgaaaccccatctctgc

SEQ ID NO: 82729 - DNA, 201 bp, Homo sapiens
ggctggggcgctgggaggccagccctcaacccttctgtctcaccctccagcctaaagctccttgacaactgggacagcgtgacctccaccttcagcaagckgcgcgaacagctcggccctgtgacccaggagttctgggataacctggaaaaggagacagagggcctgaggcaggagatgagcaaggatctggaggaggtg

SEQ ID NO: 82730 - DNA, 201 bp, Homo sapiens
gaaagaaagaaagaaagaaagaaagaaatagaaagagaaagaaagggaaaggaaaggaaaatggaaatgagggctaaaacggcgcgccctaggactgctcyggggagaaaggagggacctgggaggaatgcagtctcaactctgtcatctctcccgcagcagcctgacaaaggccctgtgaggaaagaggaggctgaagag

SEQ ID NO: 82731 - DNA, 201 bp, Homo sapiens
tggcaggaggagatggagctctaccgccagaaggtggagccgctgcgcgcagagctccaagagggcgcgcgccagaagctgcacgagctgcaagagaagckgagcccactgggcgaggagatgcgcgaccgcgcgcgcgcccatgtggacgcgctgcgcacgcatctggccccctacagcgacgagctgcgccagcgcttg

SEQ ID NO: 82732 - DNA, 201 bp, Homo sapiens
ggcgtgcttcatgtagccctgcatgaagctgagaagggaggcatcctcggcctctgaagctcctgaggaaagagcagggctgagtggggtggatcggcctmtggacgagccctgggctcctgcttgaccacccattgggactgggatccccaagttgcctccaccctgcccccagcccagtcccaccaagtgcttacgggc

SEQ ID NO: 82733 - DNA, 201 bp, Homo sapiens
aggtgtggtggcaggtgcctgtagtccctgctactcaggaggctgagacaggagaatggcttgaacccaggaggcagaggttactgcagcaagccaagatygcaccactgcactctagcctgggtgacagcgggatactacatctcaaaaaaaaaaaaaaaagcggagcgggggtggaattttcctatagttttctccttt

SEQ ID NO: 82734 - DNA, 201 bp, Homo sapiens
ggatccttaaagagtggacacaggctggacccttcatgacgtgacccccattggccgagtgaaaggatagccaaataagtatttggaaagaaagggagggscctggcatggctcacgcctgtaaatccagcacttctggaggccgatgggggtggatcatctgaggtcaggagtttgagaccagcctggccaatgtggcaa

SEQ ID NO: 82735 - DNA, 201 bp, Homo sapiens
cctgagcgctctcgaggagtacactaagaagctcaacacccagtgaggcgcccgccgccgccccccttcccggtgctcagaataaacgtttccaaagtggraagcagcttctttcttttgggagaatagaggggggtgcggggacatccgggggagcccgggtggggcctttggccctggagcagggacttcctgccggat

SEQ ID NO: 82736 - DNA, 201 bp, Homo sapiens
caagagctggctgcttagagactgcgagaaggaggtgcgtcctgctgcctgccccggtcactctggctccccagctcaaggttcaggccttgccccaggcygggcctctgggtacctgaggtcttctcccgctctgtgcccttctcctcacctggctgcaatgagtgggggagcacggggcttctgcatgctgaaggcacc

SEQ ID NO: 82737 - DNA, 201 bp, Homo sapiens
cccagagcccctgggatcgagtgaaggacctggccactgtgtacgtggatgtgctcaaagacagcggcagagactatgtgtcccagtttgaaggctccgcyttgggaaaacagctaaagtaaggacccagcctggggttgagggcaggggcagggggcagaggcctgtgggatgatgttgaagccagactggccgagtcct

SEQ ID NO: 82738 - DNA, 201 bp, Homo sapiens
ctgagcccactgggcgaggagatgcgcgaccgcgcgcgcgcccatgtggacgcgctgcgcacgcatctggccccctacagcgacgagctgcgccagcgctyggccgcgcgccttgaggctctcaaggagaacggcggcgccagactggccgagtaccacgccaaggccaccgagcatctgagcacgctcagcgagaaggcc

SEQ ID NO: 82739 - DNA, 201 bp, Homo sapiens
gagatggagctctaccgccagaaggtggagccgctgcgcgcagagctccaagagggcgcgcgccagaagctgcacgagctgcaagagaagctgagcccackgggcgaggagatgcgcgaccgcgcgcgcgcccatgtggacgcgctgcgcacgcatctggccccctacagcgacgagctgcgccagcgcttggccgcgcgc

SEQ ID NO: 82740 - DNA, 201 bp, Homo sapiens
ttccagccccaccccctatgtagctttgggcaagtgacacccctcccgggcctccatgttcttcaggttatgatgaggggtggggggcacccgtccagctscgaggcttccttagctctagcaagtgcttctccaggcttgctggctgggctgggcagggagctcctcttgcccctcttcatcctcctcccctcctctttc

SEQ ID NO: 82741 - DNA, 201 bp, Homo sapiens
agggggcagaggcctgtgggatgatgttgaagccagactggccgagtcctcacctaatatctgatgagctgggccccacagatggtctggatggagaaacyggaatgggatctccaggcagggtcacagcccatgtcccctgcaaaggacagaccagggctgcccgatgcgtgatcacagagccacattgtgcctgcaagt

SEQ ID NO: 82742 - DNA, 201 bp, Homo sapiens
gggccccacagatggtctggatggagaaaccggaatgggatctccaggcagggtcacagcccatgtcccctgcaaaggacagaccagggctgcccgatgcrtgatcacagagccacattgtgcctgcaagtgtagcaagcccctttcccttcttcaccacctcctctgctcctgcccagcaagactgtgggctgtcttcgg

SEQ ID NO: 82743 - DNA, 201 bp, Homo sapiens
tcctgctgcctgccccggtcactctggctccccagctcaaggttcaggccttgccccaggccgggcctctgggtacctgaggtcttctcccgctctgtgcycttctcctcacctggctgcaatgagtgggggagcacggggcttctgcatgctgaaggcaccccactcagccaggcccttcttctcctccaggtcccccac

SEQ ID NO: 82744 - DNA, 201 bp, Homo sapiens
cagcaagactgtgggctgtcttcggagaggagaatgcgctggaggcatagaagcgaggtccttcaagggcccactttggagaccaacgtaactgggcaccmgtcccagctctgtctcctttttagctcctctctgtgcctcggtccagctgcacaacggggcatggcctggcggggcaggggtgttggttgagagtgtact

SEQ ID NO: 82745 - DNA, 201 bp, Homo sapiens
ccaggctcggcatttctggcagcaagatgaacccccccagagcccctgggatcgagtgaaggacctggccactgtgtacgtggatgtgctcaaagacagcsgcagagactatgtgtcccagtttgaaggctccgccttgggaaaacagctaaagtaaggacccagcctggggttgagggcaggggcagggggcagaggcct

SEQ ID NO: 82746 - DNA, 201 bp, Homo sapiens
acagcgtgacctccaccttcagcaagctgcgcgaacagctcggccctgtgacccaggagttctgggataacctggaaaaggagacagagggcctgaggcargagatgagcaaggatctggaggaggtgaaggccaaggtgcagccctacctggacgacttccagaagaagtggcaggaggagatggagctctaccgccaga

SEQ ID NO: 82747 - DNA, 201 bp, Homo sapiens
gagcgccaggagggcaacaacaaggagtacccggggctgcatggcacctctgttcctgcaaggaagtgtcctgtgaggggcaccccaggtccccatgcctstggacccctccctggggaggtggcgtggcccctaaggtagaaccttagctgggtctgccagaaggagtaggggccggctccctgctaatacgggctctca

SEQ ID NO: 82748 - DNA, 201 bp, Homo sapiens
agcccacagctggcctgatctgggtctcccctcccaccctcagggagccaggctcggcatttctggcagcaagatgaacccccccagagcccctgggatckagtgaaggacctggccactgtgtacgtggatgtgctcaaagacagcggcagagactatgtgtcccagtttgaaggctccgccttgggaaaacagctaaag

SEQ ID NO: 82749 - DNA, 201 bp, Homo sapiens
ctgtaatcccagctacttgggaggctgaggcaggagaatgggttgaacccgggagacggaggttgcagtgagccgagatggcaccactgcactccagcctrggtgacagagggagactccattaaaaaaaaaagaagaagaaagaaagagagaaaggaagagagggaaagaaagaaaaaggaaagaaagaaagaaagagaa

SEQ ID NO: 82750 - DNA, 201 bp, Homo sapiens
gatctcagcccacagctggcctgatctgggtctcccctcccaccctcagggagccaggctcggcatttctggcagcaagatgaacccccccagagcccctrggatcgagtgaaggacctggccactgtgtacgtggatgtgctcaaagacagcggcagagactatgtgtcccagtttgaaggctccgccttgggaaaacag

SEQ ID NO: 82751 - DNA, 201 bp, Homo sapiens
ttatcttacagttatggaggacagaagtccaaaatgggtcatactgggctaaaatcatggtggcagcagagctgtgctcctggaggctgcagggaaaaatmctttgccttctccagcttctagggaagggttgctcatgtccctcagctcatggcccccttccagcagtcacatgagtctgatctccactgccatcctcac

SEQ ID NO: 82752 - DNA, 201 bp, Homo sapiens
tggtccctggtgccaaaaaggctgaggaccactgctctagccagaccttcagaaaaggaaaatggggccaggcgcagtggctcgtgcctgtaatcccagcrctttgggaggccgaggcaggaggatcccctgaggtcaggaattcaagaccaacctggccaacatggtgaaaccccatctctgctaaaaatacaaaaatta

SEQ ID NO: 82753 - DNA, 201 bp, Homo sapiens
ccagcgctaaatagtaaccgctgaaggatgcagggcagctgtgagctgcagttttcccacaggcaaaaatcacaagggtaaaatctggcctccagccttayagggatattctaagttgtgaaagtgctttggccacaaagaactgcgcaaatgttaaatactaggtttagccataacaatcattttagtaacaaaccaaag

SEQ ID NO: 82754 - DNA, 201 bp, Homo sapiens
gcaggagggcaggagagaatcttgcatagctggctacggtgccccacccaagggtctaacttggggctctatcacaaaagctgcagcaaaattgccaaaartaggaactactgggggtgggggtcctgtctcccctgctcagtcaccacctcccctccctaactctcattctggctcataccacgtgctcccagaagaaac

SEQ ID NO: 82755 - DNA, 201 bp, Homo sapiens
tgtctggggtaggactgggctgtctaaggcttcctccagccctaagcctgaagaatgaggggggaacctgcacttggagccacttccagccccaccccctrtgtagctttgggcaagtgacacccctcccgggcctccatgttcttcaggttatgatgaggggtggggggcacccgtccagctccgaggcttccttagctc

SEQ ID NO: 82756 - DNA, 201 bp, Homo sapiens
aggtggcgtggcccctaaggtagaaccttagctgggtctgccagaaggagtaggggccggctccctgctaatacgggctctcagaagggggactggtgagsggcgagggatcgaggcccaaagggaggtgggtgggatggagcagaaaacccaccagactgaacatcaaggcacctgcggtctggactgatctccgtccag

SEQ ID NO: 82757 - DNA, 201 bp, Homo sapiens
ttcagcaagctgcgcgaacagctcggccctgtgacccaggagttctgggataacctggaaaaggagacagagggcctgaggcaggagatgagcaaggatcyggaggaggtgaaggccaaggtgcagccctacctggacgacttccagaagaagtggcaggaggagatggagctctaccgccagaaggtggagccgctgcgc

SEQ ID NO: 82758 - DNA, 201 bp, Homo sapiens
ggtccccatgcctctggacccctccctggggaggtggcgtggcccctaaggtagaaccttagctgggtctgccagaaggagtaggggccggctccctgctmatacgggctctcagaagggggactggtgaggggcgagggatcgaggcccaaagggaggtgggtgggatggagcagaaaacccaccagactgaacatcaag

SEQ ID NO: 82759 - DNA, 201 bp, Homo sapiens
aaagaaagaagaaaagaaagaaagaaaggaaagaaagaaaggaaagaaagaaagaaagaaagaaagaaagaaagaaagaaagaaagaaagaaatagaaagrgaaagaaagggaaaggaaaggaaaatggaaatgagggctaaaacggcgcgccctaggactgctccggggagaaaggagggacctgggaggaatgcagtct

SEQ ID NO: 82760 - DNA, 201 bp, Homo sapiens
gcacagcacgaagtgagtggtgggtgagtgagcaataccgcctgagctccgcctcctgtcagatcaagtggccttacattctcataggagtgtgaaccctrttgtgaactgcacatgccagggatctaggtggagggctccttatgagaatctaatgcctgatgatctgaggtggaacagcttcatcccaaaaccatcccc

SEQ ID NO: 82761 - DNA, 201 bp, Homo sapiens
gtactgatgggcaggggcaggatgggagaggaaggacacacttctgctcacactggccccaggtcttagaacaaagcagaagcactcacgggcttgaattrggtcaggtggggcctcccaaggcaaacccctagcccaggggtccccaacccccaagtcatagataggtactggtccatggactgttaggagccgggctgc

SEQ ID NO: 82762 - DNA, 201 bp, Homo sapiens
gagcccactgggcgaggagatgcgcgaccgcgcgcgcgcccatgtggacgcgctgcgcacgcatctggccccctacagcgacgagctgcgccagcgcttgsccgcgcgccttgaggctctcaaggagaacggcggcgccagactggccgagtaccacgccaaggccaccgagcatctgagcacgctcagcgagaaggccaa

SEQ ID NO: 82763 - DNA, 201 bp, Homo sapiens
ccagctttattgggaggccagcatgcctggaggggggccaggcatgaggtggggtaggagagcactgagaatactgtcccttttaagcaacctacaggggmagccctggagattgcaggacccaaggagctggcaggatggataggcaggtggacttggggtattgaggtctcaggcagccacggctgaagttggtctgac

SEQ ID NO: 82764 - DNA, 201 bp, Homo sapiens
agctgcacaacggggcatggcctggcggggcaggggtgttggttgagagtgtactggaaatgctaggccactgcacctccgcggacaggtgtcacccaggsctcacccctgataggctggggcgctgggaggccagccctcaacccttctgtctcaccctccagcctaaagctccttgacaactgggacagcgtgacctcc

SEQ ID NO: 82765 - DNA, 201 bp, Homo sapiens
ggacagcgtgacctccaccttcagcaagctgcgcgaacagctcggccctgtgacccaggagttctgggataacctggaaaaggagacagagggcctgaggyaggagatgagcaaggatctggaggaggtgaaggccaaggtgcagccctacctggacgacttccagaagaagtggcaggaggagatggagctctaccgcca

SEQ ID NO: 82766 - DNA, 201 bp, Homo sapiens
gatctgaagagtggagccctactcaagccatctgcagctctcgggctctctgacctgacatctttcgggtggtggggacacaaaggaagcagcctctattrggagaccttgtgcttctttttggtcccaggacactgccccccaccactccagtccgggtcccaagggcccagtcagctcaactgtaatcatgacaacatt

SEQ ID NO: 82767 - DNA, 201 bp, Homo sapiens
gcagtgagccgagatggcaccactgcactccagcctgggtgacagagggagactccattaaaaaaaaaagaagaagaaagaaagagagaaaggaagagagrgaaagaaagaaaaaggaaagaaagaaagaaagagaaagaaaggaaagaaagaaagaagaaaagaaagaaagaaaggaaagaaagaaaggaaagaaagaaa

SEQ ID NO: 82768 - DNA, 201 bp, Homo sapiens
gctgcacaacggggcatggcctggcggggcaggggtgttggttgagagtgtactggaaatgctaggccactgcacctccgcggacaggtgtcacccagggytcacccctgataggctggggcgctgggaggccagccctcaacccttctgtctcaccctccagcctaaagctccttgacaactgggacagcgtgacctcca

SEQ ID NO: 82769 - DNA, 201 bp, Homo sapiens
cttgcactcatgtctgaatgtccccgcgtgcacgcacatggcttcacagatctgggcagtgccttccctaccctctctctgcagggccttttgccccctcwtgcaggcccctggataatcggccccatccccatgtccccatctccagtgtatcttagctaccctaggtaaaggagtgggctttttagttcctaaccttcc

SEQ ID NO: 82770 - DNA, 201 bp, Homo sapiens
tgcagtgagccgagatggcaccactgcactccagcctgggtgacagagggagactccattaaaaaaaaaagaagaagaaagaaagagagaaaggaagagarggaaagaaagaaaaaggaaagaaagaaagaaagagaaagaaaggaaagaaagaaagaagaaaagaaagaaagaaaggaaagaaagaaaggaaagaaagaa

SEQ ID NO: 82771 - DNA, 201 bp, Homo sapiens
ccaggagttctgggataacctggaaaaggagacagagggcctgaggcaggagatgagcaaggatctggaggaggtgaaggccaaggtgcagccctacctgsacgacttccagaagaagtggcaggaggagatggagctctaccgccagaaggtggagccgctgcgcgcagagctccaagagggcgcgcgccagaagctgca

SEQ ID NO: 82772 - DNA, 201 bp, Homo sapiens
tctgtgagatggtggcatggggagaggctggagtgatgtcacagttcctctcagcctgcatcacaggctctaggactcaggtcctatcagtaacctgctgrgggaggtctgggccttccaggagaaacctgacaagatggtgctgcaaacaccaacggacacacagcactttacattcacaggctgtctcaggggcctcca

SEQ ID NO: 82773 - DNA, 201 bp, Homo sapiens
aggggagtgaagtagtctccctggaatgctggtggtgggggaggcagtctccttggtggaggagtcccagcgtccctcccctcccctcctctgccaacacmatggacaatggcaactgcccacacactcccatggaggggaaggggatgagtgcagggaaccccgaccccacccgggagacctgcaagcctgcagacactc

SEQ ID NO: 82774 - DNA, 201 bp, Homo sapiens
cggaggttgcagtgagccgagatggcaccactgcactccagcctgggtgacagagggagactccattaaaaaaaaaagaagaagaaagaaagagagaaagraagagagggaaagaaagaaaaaggaaagaaagaaagaaagagaaagaaaggaaagaaagaaagaagaaaagaaagaaagaaaggaaagaaagaaaggaaa

SEQ ID NO: 82775 - DNA, 201 bp, Homo sapiens
agaagagcactggtgggaggacagggcgggggaagggggaggggagtgaagtagtctccctggaatgctggtggtgggggaggcagtctccttggtggagkagtcccagcgtccctcccctcccctcctctgccaacacaatggacaatggcaactgcccacacactcccatggaggggaaggggatgagtgcagggaacc

SEQ ID NO: 82776 - DNA, 201 bp, Homo sapiens
cgggagacggaggttgcagtgagccgagatggcaccactgcactccagcctgggtgacagagggagactccattaaaaaaaaaagaagaagaaagaaagaragaaaggaagagagggaaagaaagaaaaaggaaagaaagaaagaaagagaaagaaaggaaagaaagaaagaagaaaagaaagaaagaaaggaaagaaaga

SEQ ID NO: 82777 - DNA, 201 bp, Homo sapiens
ttgaacccgggagacggaggttgcagtgagccgagatggcaccactgcactccagcctgggtgacagagggagactccattaaaaaaaaaagaagaagaargaaagagagaaaggaagagagggaaagaaagaaaaaggaaagaaagaaagaaagagaaagaaaggaaagaaagaaagaagaaaagaaagaaagaaaggaa

SEQ ID NO: 82778 - DNA, 201 bp, Homo sapiens
aacctggaaaaggagacagagggcctgaggcaggagatgagcaaggatctggaggaggtgaaggccaaggtgcagccctacctggacgacttccagaagawgtggcaggaggagatggagctctaccgccagaaggtggagccgctgcgcgcagagctccaagagggcgcgcgccagaagctgcacgagctgcaagagaag

SEQ ID NO: 82779 - DNA, 201 bp, Homo sapiens
caagagggcgcgcgccagaagctgcacgagctgcaagagaagctgagcccactgggcgaggagatgcgcgaccgcgcgcgcgcccatgtggacgcgctgcscacgcatctggccccctacagcgacgagctgcgccagcgcttggccgcgcgccttgaggctctcaaggagaacggcggcgccagactggccgagtaccac

SEQ ID NO: 82780 - DNA, 201 bp, Homo sapiens
gccatcggtcacccagcccctaaatcagtcaggggaagcaacagagcagggcatgagaactcctctgtaggcaaccatgggacccacacccatgtccccaytggacgacaccagtcaggaccacaccaccctctcaacttcactggacgacagccctgagacctcaggcaggaatcccccacagctgccaccctgggagaa

SEQ ID NO: 82781 - DNA, 201 bp, Homo sapiens
gagtagccaccctggtgaataagtatatttagaaaaggaaactgcctgcttggtaagatgctgttcaacagcaccccctatcctgatgcctcgcagtcccygagccaggaaactgagaagtccctgatcagactgcaaaggctgcaggctccgcaagggtgcaaggccaccctcaaagaactagaagccaggcctcccgat

SEQ ID NO: 82782 - DNA, 201 bp, Homo sapiens
agggctctcccctctccccaggtttaccagtttgggaggcttggagagaggcctggaggacctgctggggactaaagaagagcactggtgggaggacaggdcgggggaagggggaggggagtgaagtagtctccctggaatgctggtggtgggggaggcagtctccttggtggaggagtcccagcgtccctcccctcccct

SEQ ID NO: 82783 - DNA, 201 bp, Homo sapiens
ggatagccaaataagtatttggaaagaaagggaggggcctggcatggctcacgcctgtaaatccagcacttctggaggccgatgggggtggatcatctgargtcaggagtttgagaccagcctggccaatgtggcaaaaccccgtgtctactaaaaatacaaaaattagccaggtgtggtggcaggtgcctgtagtccctg

SEQ ID NO: 82784 - DNA, 201 bp, Homo sapiens
gcaaggatctggaggaggtgaaggccaaggtgcagccctacctggacgacttccagaagaagtggcaggaggagatggagctctaccgccagaaggtggakccgctgcgcgcagagctccaagagggcgcgcgccagaagctgcacgagctgcaagagaagctgagcccactgggcgaggagatgcgcgaccgcgcgcgcg

SEQ ID NO: 82785 - DNA, 201 bp, Homo sapiens
acctgcaagcctgcagacactcccctcccgcccccactgaacccttgacccctgccctgcagcccccgcagcttgctgtttgcccactctatttgcccagycccagggacagagctgatccttgaactcttaagttccacattgccaggaccagtgagcagcaacagggccggggctgggcttatcagcctcccagcccag

SEQ ID NO: 82786 - DNA, 201 bp, Homo sapiens
aaagctgtcaaggaaggcagggtacggagggtgattcctaccttagagatgaagaaactgaggcccagagactgcccagctaccagaaggtggatagagcrctggcctccatgcctgcctgacctggagtctgtccagtgcccacccacagaacagcctcggccctttcccatgcccagacacagatggcacacttgcgac

SEQ ID NO: 82787 - DNA, 201 bp, Homo sapiens
aggggatgagtgcagggaaccccgaccccacccgggagacctgcaagcctgcagacactcccctcccgcccccactgaacccttgacccctgccctgcagsccccgcagcttgctgtttgcccactctatttgcccagccccagggacagagctgatccttgaactcttaagttccacattgccaggaccagtgagcagca

SEQ ID NO: 82788 - DNA, 201 bp, Homo sapiens
aagctgagcccactgggcgaggagatgcgcgaccgcgcgcgcgcccatgtggacgcgctgcgcacgcatctggccccctacagcgacgagctgcgccagcscttggccgcgcgccttgaggctctcaaggagaacggcggcgccagactggccgagtaccacgccaaggccaccgagcatctgagcacgctcagcgagaag

SEQ ID NO: 82789 - DNA, 201 bp, Homo sapiens
gggagggaggccagcgggtgtacctggcctgctgggccacctgggactcctgcacgctgctcagtgcatccttggcggtcttggtggcgtgcttcatgtarccctgcatgaagctgagaagggaggcatcctcggcctctgaagctcctgaggaaagagcagggctgagtggggtggatcggcctctggacgagccctggg

SEQ ID NO: 82790 - DNA, 201 bp, Homo sapiens
gctcctcttgcccctcttcatcctcctcccctcctctttcccctccccagagggcattacctggagcagctgcctctagggatgaactgagcagacaggcmggagggttctgacctgttttatatcatctccagggcagcaggcactgaggacccagggcgctgggcaaaggtcacctgctgaccagtggagatgagggcc

SEQ ID NO: 82791 - DNA, 201 bp, Homo sapiens
ctggcatggctcacgcctgtaaatccagcacttctggaggccgatgggggtggatcatctgaggtcaggagtttgagaccagcctggccaatgtggcaaarccccgtgtctactaaaaatacaaaaattagccaggtgtggtggcaggtgcctgtagtccctgctactcaggaggctgagacaggagaatggcttgaaccc

SEQ ID NO: 82792 - DNA, 201 bp, Homo sapiens
ccacattgtgcctgcaagtgtagcaagcccctttcccttcttcaccacctcctctgctcctgcccagcaagactgtgggctgtcttcggagaggagaatgygctggaggcatagaagcgaggtccttcaagggcccactttggagaccaacgtaactgggcaccagtcccagctctgtctcctttttagctcctctctgtg

SEQ ID NO: 82793 - DNA, 201 bp, Homo sapiens
atgtcccctgcaaaggacagaccagggctgcccgatgcgtgatcacagagccacattgtgcctgcaagtgtagcaagcccctttcccttcttcaccacctyctctgctcctgcccagcaagactgtgggctgtcttcggagaggagaatgcgctggaggcatagaagcgaggtccttcaagggcccactttggagaccaac

SEQ ID NO: 82794 - DNA, 201 bp, Homo sapiens
aactgcctgcttggtaagatgctgttcaacagcaccccctatcctgatgcctcgcagtccctgagccaggaaactgagaagtccctgatcagactgcaaargctgcaggctccgcaagggtgcaaggccaccctcaaagaactagaagccaggcctcccgattcccacccctgccagcgctaaatagtaaccgctgaagga

SEQ ID NO: 82795 - DNA, 201 bp, Homo sapiens
aatgcctggctggaccctgagtctgagtgtgtcatcaacccagtttgttattgtcgttgttgttgttatgtatttttccatcagctctgtccagaaagacytccttcctttccaaaatattagtaaagggggcttagactagtttaagccaaataccttgcaataaaatggagtagccaccctggtgaataagtatattta

SEQ ID NO: 82796 - DNA, 201 bp, Homo sapiens
gggttgaacccgggagacggaggttgcagtgagccgagatggcaccactgcactccagcctgggtgacagagggagactccattaaaaaaaaaagaagaaraaagaaagagagaaaggaagagagggaaagaaagaaaaaggaaagaaagaaagaaagagaaagaaaggaaagaaagaaagaagaaaagaaagaaagaaag

SEQ ID NO: 82797 - DNA, 201 bp, Homo sapiens
acagagatgtcagcctggtttctagtgttagggagtttcctggagtgatggtacagggtacatttctgccctgcatcccaagtccagagactgggttctargtccagcctttcttctaactccctgagagatgacagcctctgggcaaagtccctctgtgctcttcagtctcttcatctgtgagatggtggcatggggaga

SEQ ID NO: 82798 - DNA, 201 bp, Homo sapiens
ctatttctgttctttgaaaatgtcagaaatatttttttctttctcattttatgttgaactaaaaaggattaaaaaaaaaatctccagactcaagttgctamgaccttttgtcctgccttttgtccttccttttgtgaggcacttacttacaacttggttacttagttggacagcaggaagttgtgtagataggagcctgat

SEQ ID NO: 82799 - DNA, 201 bp, Homo sapiens
aaggggatgagtgcagggaaccccgaccccacccgggagacctgcaagcctgcagacactcccctcccgcccccactgaacccttgacccctgccctgcascccccgcagcttgctgtttgcccactctatttgcccagccccagggacagagctgatccttgaactcttaagttccacattgccaggaccagtgagcagc

SEQ ID NO: 82800 - DNA, 201 bp, Homo sapiens
ctctgctaaaaatacaaaaattagctgggtgtggtggcgcgtgcctgtaatcccagctacttgggaggctgaggcaggagaatgggttgaacccgggagayggaggttgcagtgagccgagatggcaccactgcactccagcctgggtgacagagggagactccattaaaaaaaaaagaagaagaaagaaagagagaaagg

SEQ ID NO: 82801 - DNA, 201 bp, Homo sapiens
gcaggaggatcccctgaggtcaggaattcaagaccaacctggccaacatggtgaaaccccatctctgctaaaaatacaaaaattagctgggtgtggtggcrcgtgcctgtaatcccagctacttgggaggctgaggcaggagaatgggttgaacccgggagacggaggttgcagtgagccgagatggcaccactgcactcc

SEQ ID NO: 82802 - DNA, 201 bp, Homo sapiens
cacaaaactggtccctggtgccaaaaaggctgaggaccactgctctagccagaccttcagaaaaggaaaatggggccaggcgcagtggctcgtgcctgtartcccagcactttgggaggccgaggcaggaggatcccctgaggtcaggaattcaagaccaacctggccaacatggtgaaaccccatctctgctaaaaatac

SEQ ID NO: 82803 - DNA, 201 bp, Homo sapiens
gcgaccgcgcgcgcgcccatgtggacgcgctgcgcacgcatctggccccctacagcgacgagctgcgccagcgcttggccgcgcgccttgaggctctcaargagaacggcggcgccagactggccgagtaccacgccaaggccaccgagcatctgagcacgctcagcgagaaggccaagcccgcgctcgaggacctccgcc

SEQ ID NO: 82804 - DNA, 201 bp, Homo sapiens
cagcgacgagctgcgccagcgcttggccgcgcgccttgaggctctcaaggagaacggcggcgccagactggccgagtaccacgccaaggccaccgagcatytgagcacgctcagcgagaaggccaagcccgcgctcgaggacctccgccaaggcctgctgcccgtgctggagagcttcaaggtcagcttcctgagcgctct

SEQ ID NO: 82805 - DNA, 201 bp, Homo sapiens
ccaggggtccccaacccccaagtcatagataggtactggtccatggactgttaggagccgggctgcacagcacgaagtgagtggtgggtgagtgagcaatmccgcctgagctccgcctcctgtcagatcaagtggccttacattctcataggagtgtgaaccctattgtgaactgcacatgccagggatctaggtggaggg

SEQ ID NO: 82806 - DNA, 201 bp, Homo sapiens
ccagactggccgagtaccacgccaaggccaccgagcatctgagcacgctcagcgagaaggccaagcccgcgctcgaggacctccgccaaggcctgctgccsgtgctggagagcttcaaggtcagcttcctgagcgctctcgaggagtacactaagaagctcaacacccagtgaggcgcccgccgccgccccccttcccggt

SEQ ID NO: 82807 - DNA, 201 bp, Homo sapiens
ccccacggcccttcaggatgaaagctgcggtgctgaccttggccgtgctcttcctgacgggtaggtgtcccctaacctagggagccaaccatcggggggcyttctccctaaatccccgtggcccaccctcctgggcagaggcagcaggtttctcactggccccctctcccccacctccaagcttggcctttcggctcagat

SEQ ID NO: 82808 - DNA, 201 bp, Homo sapiens
caagtggtggagccaagaatagtgcctcgttgcatcttactccaacctctagcccatccggcctcctcccttcacgtgcgcctaagagggctaggtggccyggataggggaggtcagctccacagttttgagtaaacacacacagtctcaactctgatgacaacttaagtgccaggcatagtggctggcatggggcacaca

SEQ ID NO: 82809 - DNA, 201 bp, Homo sapiens
gtccaaatcccagaactcagagaacttgtccttaacggtgctccagtagtctttcagggaactgaagccatcggtcacccagcccctaaatcagtcagggraagcaacagagcagggcatgagaactcctctgtaggcaaccatgggacccacacccatgtccccactggacgacaccagtcaggaccacaccaccctctc

SEQ ID NO: 82810 - DNA, 201 bp, Homo sapiens
cttgctgtttgcccactctatttgcccagccccagggacagagctgatccttgaactcttaagttccacattgccaggaccagtgagcagcaacagggccrgggctgggcttatcagcctcccagcccagaccctggctgcagacataaataggccctgcaagagctggctgcttagagactgcgagaaggaggtgcgtcc

SEQ ID NO: 82811 - DNA, 201 bp, Homo sapiens
tgatctggggcaggtcacctaatcgctctgagcctcaattttctcatctgcaaagtgagaaaataacacctaccccaaagccggttctggggactaagaawgtttatgaacacctctgctatgccagctaatgccagtcagggtgaggtggagaagggagtaggggagaggagagtactgatgggcaggggcaggatggga

SEQ ID NO: 82812 - DNA, 201 bp, Homo sapiens
aagagctggctgcttagagactgcgagaaggaggtgcgtcctgctgcctgccccggtcactctggctccccagctcaaggttcaggccttgccccaggccrggcctctgggtacctgaggtcttctcccgctctgtgcccttctcctcacctggctgcaatgagtgggggagcacggggcttctgcatgctgaaggcaccc

SEQ ID NO: 82813 - DNA, 201 bp, Homo sapiens
gacatctttcgggtggtggggacacaaaggaagcagcctctattgggagaccttgtgcttctttttggtcccaggacactgccccccaccactccagtccrggtcccaagggcccagtcagctcaactgtaatcatgacaacattgatcaagcatctttacgtgcaggtgctgtgccaaacggttcgaacgctctctcatt

SEQ ID NO: 82814 - DNA, 201 bp, Homo sapiens
cgcgcgccagaagctgcacgagctgcaagagaagctgagcccactgggcgaggagatgcgcgaccgcgcgcgcgcccatgtggacgcgctgcgcacgcatytggccccctacagcgacgagctgcgccagcgcttggccgcgcgccttgaggctctcaaggagaacggcggcgccagactggccgagtaccacgccaaggc

SEQ ID NO: 82815 - DNA, 201 bp, Homo sapiens
ccagccccaccccctatgtagctttgggcaagtgacacccctcccgggcctccatgttcttcaggttatgatgaggggtggggggcacccgtccagctccraggcttccttagctctagcaagtgcttctccaggcttgctggctgggctgggcagggagctcctcttgcccctcttcatcctcctcccctcctctttccc

SEQ ID NO: 82816 - DNA, 201 bp, Homo sapiens
gtggcctggcactcaagttcacatgggtgtgcaggcatgcctgtgtattctcacatgacctccctgctcacggtccctccttgcactcatgtctgaatgtmcccgcgtgcacgcacatggcttcacagatctgggcagtgccttccctaccctctctctgcagggccttttgccccctcatgcaggcccctggataatcgg

SEQ ID NO: 82817 - DNA, 201 bp, Homo sapiens
ggagccacttccagccccaccccctatgtagctttgggcaagtgacacccctcccgggcctccatgttcttcaggttatgatgaggggtggggggcacccrtccagctccgaggcttccttagctctagcaagtgcttctccaggcttgctggctgggctgggcagggagctcctcttgcccctcttcatcctcctcccct

SEQ ID NO: 82818 - DNA, 201 bp, Homo sapiens
acctgggaggcagaggtcacagtgagccgaaatcatgccactgcactccagcctgggcgacggagcaagactccagctaaaaaaaaaaaaaaaaaaaaaargagtgtgtggcctggcactcaagttcacatgggtgtgcaggcatgcctgtgtattctcacatgacctccctgctcacggtccctccttgcactcatgtct

SEQ ID NO: 82819 - DNA, 201 bp, Homo sapiens
cagggatctaggtggagggctccttatgagaatctaatgcctgatgatctgaggtggaacagcttcatcccaaaaccatccccgctggcccatggaaaaawtgtccaccacaaaactggtccctggtgccaaaaaggctgaggaccactgctctagccagaccttcagaaaaggaaaatggggccaggcgcagtggctcgt

SEQ ID NO: 82820 - DNA, 201 bp, Homo sapiens
ctggacctgtgacgtcgcttgcccagtgaacagcaggatgggctaggcagcgctttttagaccctgcacccctggccatccatgattattgaaaagagtgygcgggtcgggtgcggtggctcaagcctgtaatcccagcactttgggaggctgaggtgggcgtatcacttcaggccaggagtttgagaccagcctggccaa

SEQ ID NO: 82821 - DNA, 201 bp, Homo sapiens
ggataggcaggtggacttggggtattgaggtctcaggcagccacggctgaagttggtctgacctcagggtccaaatcccagaactcagagaacttgtcctyaacggtgctccagtagtctttcagggaactgaagccatcggtcacccagcccctaaatcagtcaggggaagcaacagagcagggcatgagaactcctctg

SEQ ID NO: 82822 - DNA, 201 bp, Homo sapiens
gaatagaggggggtgcggggacatccgggggagcccgggtggggcctttggccctggagcagggacttcctgccggatctcaacaactccgtgcccagacwggacgtcttagggccaagatcgacgttggaggacctgctggacgcctggctgcttacgagtgagggagtagagtctgccttagcaaggctcaagtagaaa

SEQ ID NO: 82823 - DNA, 201 bp, Homo sapiens
cgagtcctcacctaatatctgatgagctgggccccacagatggtctggatggagaaaccggaatgggatctccaggcagggtcacagcccatgtcccctgmaaaggacagaccagggctgcccgatgcgtgatcacagagccacattgtgcctgcaagtgtagcaagcccctttcccttcttcaccacctcctctgctcct

SEQ ID NO: 82824 - DNA, 201 bp, Homo sapiens
ctacaggggaagccctggagattgcaggacccaaggagctggcaggatggataggcaggtggacttggggtattgaggtctcaggcagccacggctgaagytggtctgacctcagggtccaaatcccagaactcagagaacttgtccttaacggtgctccagtagtctttcagggaactgaagccatcggtcacccagccc

SEQ ID NO: 82825 - DNA, 201 bp, Homo sapiens
gacaggtgtcacccagggctcacccctgataggctggggcgctgggaggccagccctcaacccttctgtctcaccctccagcctaaagctccttgacaacygggacagcgtgacctccaccttcagcaagctgcgcgaacagctcggccctgtgacccaggagttctgggataacctggaaaaggagacagagggcctgag

SEQ ID NO: 82826 - DNA, 201 bp, Homo sapiens
ggggggccaggcatgaggtggggtaggagagcactgagaatactgtcccttttaagcaacctacaggggaagccctggagattgcaggacccaaggagctsgcaggatggataggcaggtggacttggggtattgaggtctcaggcagccacggctgaagttggtctgacctcagggtccaaatcccagaactcagagaac

SEQ ID NO: 82827 - DNA, 201 bp, Homo sapiens
cccccagagcccctgggatcgagtgaaggacctggccactgtgtacgtggatgtgctcaaagacagcggcagagactatgtgtcccagtttgaaggctccrccttgggaaaacagctaaagtaaggacccagcctggggttgagggcaggggcagggggcagaggcctgtgggatgatgttgaagccagactggccgagtc

SEQ ID NO: 82828 - DNA, 201 bp, Homo sapiens
ctgtgtgtctttgggtgatttctggccctctccaggcctcagtttccctgtctggggtaggactgggctgtctaaggcttcctccagccctaagcctgaaraatgaggggggaacctgcacttggagccacttccagccccaccccctatgtagctttgggcaagtgacacccctcccgggcctccatgttcttcaggtta

SEQ ID NO: 82829 - DNA, 201 bp, Homo sapiens
ctccaagagggcgcgcgccagaagctgcacgagctgcaagagaagctgagcccactgggcgaggagatgcgcgaccgcgcgcgcgcccatgtggacgcgcygcgcacgcatctggccccctacagcgacgagctgcgccagcgcttggccgcgcgccttgaggctctcaaggagaacggcggcgccagactggccgagtac

SEQ ID NO: 82830 - DNA, 201 bp, Homo sapiens
acaacaaggagtacccggggctgcatggcacctctgttcctgcaaggaagtgtcctgtgaggggcaccccaggtccccatgcctctggacccctccctggrgaggtggcgtggcccctaaggtagaaccttagctgggtctgccagaaggagtaggggccggctccctgctaatacgggctctcagaagggggactggtga

SEQ ID NO: 82831 - DNA, 201 bp, Homo sapiens
gagcaacgtgcttctggccaagttatgcaacctcgttgggcctacttatctcatttgtgcagtgggaaaaattacatacaacaattatataaatatctcayggggttgttgtgaggatccaaccagatattctacaaaataggcttagaggactgcctggtacagagtaaacaataaatattagttctcctttctccaggg

SEQ ID NO: 82832 - DNA, 201 bp, Homo sapiens
ggacagctttggaaatatatcacaaagagcaatataatagagatgatttttatttaatcaccattactcaaacttgcattatttttagacaggtcccttgycaatgtaggaagtgatctcccgtatttaaaggggatgccatttttccacagtgacatcccctggaggagacttcctgtatgttacatccaggaaacatga

SEQ ID NO: 82833 - DNA, 201 bp, Homo sapiens
cctggtaaatagtaaggatttattcaaagaaatattctgaggacagctttggaaatatatcacaaagagcaatataatagagatgatttttatttaatcamcattactcaaacttgcattatttttagacaggtcccttgccaatgtaggaagtgatctcccgtatttaaaggggatgccatttttccacagtgacatccc

SEQ ID NO: 82834 - DNA, 201 bp, Homo sapiens
ttggagagcaacctggccaacatggtgaaaccccatctctattaaaaatacaaaaattagccaggcatggtggcacgcacctgtaatgccagctactcggraggctgaggcaggataatcacttgaacccgggaggcagaggctgcagtgagctcagatggcaccactgcactccagcctgggcaacagagcaagactctg

SEQ ID NO: 82835 - DNA, 201 bp, Homo sapiens
agggctttcagccttctaggatcttgtgtggagatgctaatacccaaaaaacagagggaggtcacctctacccaacttgccatcccagtctgctgtcaggractagggtatatgctgaagaaaagaatgtgtggatgggcattcaggatgagtagcaagcttccaccttgacctgggtgcattgccctttaaatacctcct

SEQ ID NO: 82836 - DNA, 201 bp, Homo sapiens
aataatatttcatcttcatatcttgcctctcatccctctcatcttttctttctggaaaatttccagaagactcttcagaaatgtcagcgcgttgcctgccrtggtttggttgcatggctgttcacaggaaaaatactgtggggatgaaagttgataaggacagagtgactcaaatgatgtagagccaagcagccccagaag

SEQ ID NO: 82837 - DNA, 201 bp, Homo sapiens
gctggatcggaggtgagtgtgcttaccggggacccccggtcagagagagcgagcctggcggagtttgcctctatgctctgaggaaactttgcctctgtgcsctgccatcccgctccccgttgtgcgcgcagcctgctttggggagtgcccggccccgagatccccctggtggtcttgcagttgccagggctaaattctgag

SEQ ID NO: 82838 - DNA, 201 bp, Homo sapiens
aaagtgcaaaacataggggttagaggaaggggtggcctggtgtgatttttctggtttctgttctttgcctgccttcttctctgagtctgggttgtttgctktttccaggaggtgaacacaggatgactacagtgttccctgggcctcatctctgcatgtgaagccctgagagctgcagatgtttggcctttggacctccaa

SEQ ID NO: 82839 - DNA, 201 bp, Homo sapiens
gactttgcggcgggctggatcggaggtgagtgtgcttaccggggacccccggtcagagagagcgagcctggcggagtttgcctctatgctctgaggaaacyttgcctctgtgcgctgccatcccgctccccgttgtgcgcgcagcctgctttggggagtgcccggccccgagatccccctggtggtcttgcagttgccagg

SEQ ID NO: 82840 - DNA, 201 bp, Homo sapiens
gaaataaccaggctggtgagcaccttggtaatcttggctccaaggaagcagctgctgtggaggggctgtggcagtgagatgaggctgaatggcagacagakggggcatttgtaggtagacagcttctggaggcaccagggccagctgccctgggttgctgtccctggggaatctggagccttcctgtcactccaggaaacc

SEQ ID NO: 82841 - DNA, 201 bp, Homo sapiens
taatgacgatggtgaccaatttgagtagctctttgtaaccaacttaggaatgatcagtggtgcagcctttgtggtggggaaaatcaaaagtccatggactygtcgaggcatccccaagtagaaacagaaggaaagtctggtagttttggagccattctctgcccactgttagggtcgtcttgggctacatggaccatagct

SEQ ID NO: 82842 - DNA, 201 bp, Homo sapiens
atgtttttgtctacttccccaaatattaatgtgtcataattcgtaaaaagtctgtagaggcaaaatatattgctgatattatttcctctgaaaattactgkgctcttttaaaaaaatgaagtcctggaagtcagctgaggtcagacgattggtttcttaatctcgatagcgtttggtcctcactgttggttcagagacagg

SEQ ID NO: 82843 - DNA, 201 bp, Homo sapiens
cctattctcattattttaaattccttttttaaatttttaacaagagctgctctgacagaagggtgaagcccagccctggtgcggcctcaattgtcttttgkatcttttttttcttcttcttttttttttttttttttttttttttttttagcagaaatacagtttgtgattcagccaatgagtatagagggatataaaagt

SEQ ID NO: 82844 - DNA, 201 bp, Homo sapiens
aagagcaggtgtcccccaaatatattttggagggtggagcgacagacagcagatagggtagagtcccagtttaggtttttgtactcaagaggtggggatcrtacaatcattcggcacaactagctggcctttgccattctctcagcaaagcaggcttctctgcattgagtgagtctgaatgggacattagagggaggcagt

SEQ ID NO: 82845 - DNA, 201 bp, Homo sapiens
tgcacacccaggccctgggtcccagagcccaccaaggagggctgtgcagcaagttcatgtctgaagtggacttactagcatatcacggctgagccattgcwgcccagagttagggcccatgtctggcactccccagggctgtccagagctaagccaggtccttagaaaccttttccacctctgtggtagctgcccactgag

SEQ ID NO: 82846 - DNA, 201 bp, Homo sapiens
caccttgcacttttatgttgtggagatggcttctctccttaaacctcatgaaccaaccactgccagcttcaaacttttcttctgcagcttcctcacctctytccaccttcagagaattgaggagagttatgtcctttctctgagttaggctttggcttaagggaaagttgtggctcatttgatgttctatccagactactc

SEQ ID NO: 82847 - DNA, 201 bp, Homo sapiens
caggctctacatcagcacttgctgcttcaccttgcacttttatgttgtggagatggcttctctccttaaacctcatgaaccaaccactgccagcttcaaamttttcttctgcagcttcctcacctctctccaccttcagagaattgaggagagttatgtcctttctctgagttaggctttggcttaagggaaagttgtggc

SEQ ID NO: 82848 - DNA, 201 bp, Homo sapiens
ctggataacttgctgcaggctctacatcagcacttgctgcttcaccttgcacttttatgttgtggagatggcttctctccttaaacctcatgaaccaaccmctgccagcttcaaacttttcttctgcagcttcctcacctctctccaccttcagagaattgaggagagttatgtcctttctctgagttaggctttggctta

SEQ ID NO: 82849 - DNA, 201 bp, Homo sapiens
agtatagtcatgttcatcaattctcttagctagatcttctggataacttgctgcaggctctacatcagcacttgctgcttcaccttgcacttttatgttgkggagatggcttctctccttaaacctcatgaaccaaccactgccagcttcaaacttttcttctgcagcttcctcacctctctccaccttcagagaattgag

SEQ ID NO: 82850 - DNA, 201 bp, Homo sapiens
ccacagcctgacttctttccagcccaagatcactgcccctcccggcgcatgcatggcatgtgtgggttccaggccaggacacaacccacaggaaacaaagyggcctgcagaagccgggctgtcctcggagcaagaatgcctgcccctgagtggttccccaccccctacctcctgtcgcatcagcaccctcttcccctctct

SEQ ID NO: 82851 - DNA, 201 bp, Homo sapiens
ctctcatcctgctcttcacactcagcttgattttccctacttcatctcacaccacacctcaaatattatgtgttacctaaactcacccctgccactaccayagcataactgaggaaaaactccagttgtgtgtaacctctgtggagaaatcctgaagaatctggagctgcagtgtggaaaattcctgcaaaaacaaggtga

SEQ ID NO: 82852 - DNA, 201 bp, Homo sapiens
aacactgcaggttatgtgacttttgcagaaaagcctagggaaagcaccaagctatgctggtgattaatctgcatcagtgagtggaagctcgtctctgcccrtctcctctggcaagacattgcatttccgagttatattctgaaaccatcaccaaccatcagtatctgtccctgctgggatcctgcttgggctggtgtctcc

SEQ ID NO: 82853 - DNA, 201 bp, Homo sapiens
gggatgtacattaaatatatacaattatgcttaattttatcttacttgatacaatatgagcaggtttgcaaaagcgaaagagtccaaaatctaagcaagtyttaaaatggccttgattctacataaccaggagagacgagaaagataatggcaagaccatcaattctgtaggcccaaaatgagtgctctggacacctcaga

SEQ ID NO: 82854 - DNA, 201 bp, Homo sapiens
aaatataacctcatgttaaatagtcaaatgcaactcagctttcatggaggtctatgtggatgatattaatatgggatgtacattaaatatatacaattatrcttaattttatcttacttgatacaatatgagcaggtttgcaaaagcgaaagagtccaaaatctaagcaagtcttaaaatggccttgattctacataacca

SEQ ID NO: 82855 - DNA, 201 bp, Homo sapiens
tccattctgtaggatgtcttcacttttgtgtgcaaaagttttcaatttttatgaatgttattatttcttgtgttgtgtaggggagttagagataaactccraccccctgtttagctcctactgggctcttcagctgaatataaaaaccaaattgacaccagactgattaacaagagaaaaataatacagattttattagtt

SEQ ID NO: 82856 - DNA, 201 bp, Homo sapiens
taccagcaatgtacaagagttccaatttctctacatccttgccaacagttcttttccactttttttcaattgtagctatcctagtgcgtgtgaagacgtawctcattgtggtttcaatttgcatttcccaaatgactacagatgttgagcatctattcatgtgtctgttggtcatctgtatatcatctttggagaaacgtg

SEQ ID NO: 82857 - DNA, 201 bp, Homo sapiens
gtcagtgtcagtccctggaaggtggttcacacatttagggggatgtgggactatagagaagggaatcaggagaccagggggctgctggtgattatgtatcwggtgccacaagtgggtgctttgtcaagcacttcacctgggtggtcttttcacatggccagtggaggagataggtatgtgacctgacagaggttcagagag

SEQ ID NO: 82858 - DNA, 201 bp, Homo sapiens
gcataagtaacaaggagataaatgtttatcaccaagacagtggggtaaatatctgcagggcatgtcagagaccttggtgacagcccctcccatcacagacycagaggcctaggaggaaaaaatggtttcctgggctgggcccagggacctctgctctgtgcagcctagggacttggtgctctgtgtcctagccacttcagc

SEQ ID NO: 82859 - DNA, 201 bp, Homo sapiens
cactagcctactttcggtttcaggaaaactgattttcaaggaaagaagacatagtgctcttatgatacctttgctgaacattttcaaatagccccggcaaycctgagagcctctgccagtctgtactttgcctcttactgcttcacaaacccagtctccaaatgggttgtttgaccccaagatccaagatttcaagactcc

SEQ ID NO: 82860 - DNA, 201 bp, Homo sapiens
gaagggatggcctggatcctggccacagagccagcattctgcctgggctcatagccctgtggtctgggattctccaggcctggccatggttgctggtaaayctagggtcctcccctcacttccctgggtgatgcgccccatgggcaggtttgtggcatgcatatgggaatggagcacagtaattcattttggaaagcaacc

SEQ ID NO: 82861 - DNA, 201 bp, Homo sapiens
acaaaggaggaaatttctagctacccaatcacgattgtcctgcatttagcctttcacaagcagtgaccaacccaattggaagcttttctttctggaagcgytctttcttgcaaggggcatagatgtctgtctcccttaggagggaggactgctaaggcagggaggaggctattgcctcctggtgggagagggaggttccca

SEQ ID NO: 82862 - DNA, 201 bp, Homo sapiens
aacatcacagcatcttcctgcttcaaactgggtggatgtaaagagggagggatggatggatagatgggcaagctagctttatggctggccacatcttggcytgcagtgtgtgctttgatctggaatctgctggaaacaactctgcctggggcctggcaacctggagagggtagcaacttcactgcttgtgagcaacgtgct

SEQ ID NO: 82863 - DNA, 201 bp, Homo sapiens
actttggtgatgttattgaaagtaatggcaaaaatcgcaattacttttgcaccaaactaataacatggctttttttttttttggcttccatgaaatgatgktaagtgtttactacacttgaatacttactaggtgccaggtatagtttaagtgctatatgtattcttttaaaacaattttatcaaggtttattttatgtat

SEQ ID NO: 82864 - DNA, 201 bp, Homo sapiens
caggatagggaaggaattcatcttattcttaaagctgtgctcagatattggccatttcccccttttaacagagaaaagtaatttcttaaaaatcctataayaaaagccaggcatttttattgtagacaaaaatagaaaatttaaataaacagaaagaacaaaataataagacctgtcatcacaagaccttgttgttattct

SEQ ID NO: 82865 - DNA, 201 bp, Homo sapiens
caacacagtttacataattaaacatcttgagtgaagaattactgcatttgggtggcatccaggatagggaaggaattcatcttattcttaaagctgtgctsagatattggccatttcccccttttaacagagaaaagtaatttcttaaaaatcctataataaaagccaggcatttttattgtagacaaaaatagaaaattt

SEQ ID NO: 82866 - DNA, 201 bp, Homo sapiens
atcacctctactaacacagatatttccttcctcctcagtgttctcgggaatttgtctttgaagaacagtttccctttcaatttcagtcactaactgctgcmacaaggctgatacggtttggctgtttccccacccaaatctcatcttgaattgtagctcccataattccacatgtcatgggagggacccctgtgggaggta

SEQ ID NO: 82867 - DNA, 201 bp, Homo sapiens
aatatacctgtttccagacagctcgcctctccgtttccccttccagcagcttcaacagccctttcagagaagtacttttaccttcactgtgcagatgcaartgacccaggctcacaagtgaggactgcaaccagggtacctgcagggggcaccgtctccccacctccctactgaactgcacagcctgactctgagagccac

SEQ ID NO: 82868 - DNA, 201 bp, Homo sapiens
ggttctatttaaccaaatatatatatatatatatatatatatatatatatatatatatatatataaaatatatatatgtgtgtgtgtgtgtgtgtgtgtgwgagagagagagagagagagagagagagtgtgtgtgtgtgtgtgtagtctgactgtggccagtgctgttacaggcattgggtgacaatggcagggaccctg

SEQ ID NO: 82869 - DNA, 201 bp, Homo sapiens
gtcatcggatgggtggatgaccaacccccatatgccctcaggcctcctcttcctccctgtgttttttcttcctcattgtctggccccataccggctacctrcaaagctcagaagacaaagtaagtgtggactgaactttctagtcaaccaagaagccatttgacatcagtcttggttagcacaaattctcctgggaaggat

SEQ ID NO: 82870 - DNA, 201 bp, Homo sapiens
ttccccaaatattaatgtgtcataattcgtaaaaagtctgtagaggcaaaatatattgctgatattatttcctctgaaaattactgtgctcttttaaaaaratgaagtcctggaagtcagctgaggtcagacgattggtttcttaatctcgatagcgtttggtcctcactgttggttcagagacaggttttaagtcaagat

SEQ ID NO: 82871 - DNA, 201 bp, Homo sapiens
acagagaggtttcatacccccaggtccctcccttagtgggaggtggaggaggtctgattcagaggcactgatgctttctctgcttttgccccaggatttgyagaagctgaggttatgacaacgttgataacattgggccacctgggcctttgcgcaaaattgtcatgcacacaaatagcttcaaactttagggagaagtga

SEQ ID NO: 82872 - DNA, 201 bp, Homo sapiens
cttatcaaatatgcagccttaggcaaattagttaacctcactgagagtaataaattgaataattgtccctaaggtatgtatttattcagtgagacagcatrtattaagcacttagaactagatgccattgatggtagaaacgcatgcagctaaacagctgagctcagggctttcagccttctaggatcttgtgtggagatg

SEQ ID NO: 82873 - DNA, 201 bp, Homo sapiens
tattttggagggtggagcgacagacagcagatagggtagagtcccagtttaggtttttgtactcaagaggtggggatcgtacaatcattcggcacaactarctggcctttgccattctctcagcaaagcaggcttctctgcattgagtgagtctgaatgggacattagagggaggcagtgcaagctggagacagggcacca

SEQ ID NO: 82874 - DNA, 201 bp, Homo sapiens
tttgaggcctaaaattgtatcattatccttttaggttgtctttccaaggtcatttgacagtacaatggctaagagtggggctctgaggtcatataggcctsagttcaaatctcagctctgccacttatcaaatatgcagccttaggcaaattagttaacctcactgagagtaataaattgaataattgtccctaaggtatg

SEQ ID NO: 82875 - DNA, 201 bp, Homo sapiens
ttgctagaggagtcactaggagatgtgtggggggggggtataaaacaggtggaagataaggattacttcattaagtatgaattcagggccactgcagcctycagttctgaatcccagctaataagggctattttcttaccctggtatggagagggtaaccctcccagaggaatctttattgcttgctgcatgcaggaagag

SEQ ID NO: 82876 - DNA, 201 bp, Homo sapiens
cggtggtgaggattgtggggatgggaagggaagtggcttgagacacagagcaaataggtgggcaggtccaggctagctcatgtggtgtaaagacagcatakgtggttgacctcaaattggatttcaggggtctttacacacacacacacacacacacacacacacacacacacacacacacacccctattaagtggcccta

SEQ ID NO: 82877 - DNA, 201 bp, Homo sapiens
gggaatttgtctttgaagaacagtttccctttcaatttcagtcactaactgctgcaacaaggctgatacggtttggctgtttccccacccaaatctcatcytgaattgtagctcccataattccacatgtcatgggagggacccctgtgggaggtaattgaatcatgggtacaggctttcccatgctgttctcatggtagt

SEQ ID NO: 82878 - DNA, 201 bp, Homo sapiens
atctgccatcttaatttcatcttaactctttctgaacaaccttgcataacaaaattttgccctttttttgatattatccccccccccaccccccccccccmcacacacacacattttgtttgagattttactggtttgtgaagtgccaaggtctggaaatcactgaccttataatcccatttttttaaatctcaaatcccc

SEQ ID NO: 82879 - DNA, 201 bp, Homo sapiens
cccccaaatatattttggagggtggagcgacagacagcagatagggtagagtcccagtttaggtttttgtactcaagaggtggggatcgtacaatcattcrgcacaactagctggcctttgccattctctcagcaaagcaggcttctctgcattgagtgagtctgaatgggacattagagggaggcagtgcaagctggaga

SEQ ID NO: 82880 - DNA, 201 bp, Homo sapiens
agaatctgccatcttaatttcatcttaactctttctgaacaaccttgcataacaaaattttgccctttttttgatattatccccccccccacccccccccmccacacacacacacattttgtttgagattttactggtttgtgaagtgccaaggtctggaaatcactgaccttataatcccatttttttaaatctcaaatc

SEQ ID NO: 82881 - DNA, 201 bp, Homo sapiens
ccagcctggccaggactgaaacccagaccctttgctggcgggggtcactatgagcagggcctttccctctgggcatctccggagcagtggggctatgaatracctctgcgctgacccatgtccttgcctctctccatagactcgcctgcaggctggcgttggctacggaaacaccctcagctgcatccgcgtggtgtacag

SEQ ID NO: 82882 - DNA, 201 bp, Homo sapiens
cagaatctgccatcttaatttcatcttaactctttctgaacaaccttgcataacaaaattttgccctttttttgatattatccccccccccaccccccccmcccacacacacacacattttgtttgagattttactggtttgtgaagtgccaaggtctggaaatcactgaccttataatcccatttttttaaatctcaaat

SEQ ID NO: 82883 - DNA, 201 bp, Homo sapiens
tgtatatgttatgtcaattgaatcttgcaatatgtgatctcttgtgtcagtttatgtatagttctttaattattataacaaccccaaagaggtaggtaccrttgcatccttattttacagatgaggaaactgagatacagagaaattcactgacttgcctaagaccatgcatctagcattggcaccaggattccaacccag

SEQ ID NO: 82884 - DNA, 201 bp, Homo sapiens
cctgtccttccaccatggggaggtgctgacatgtctcaggataggtaagattccccgagcctcctgtatggcaatctgcccatggcctgtgccttcaggtkatttgtctgtggtgccagaaggaaaccagttctcttaaataaacccccgaggcagcaacagaaaatgaacatgtgtttgttctgttcttccctgtgtgcc

SEQ ID NO: 82885 - DNA, 201 bp, Homo sapiens
gtggcatagggtgatgaggaaggccttcaagaaaggcctgtcaggaggtgacagctgaactgagtcttaaagaagaagggggcagggattagccaggggakgagggagagggtgttccccacaagggaatagcatgtgcgcagtcacacacatgcacagaatgtgagacattgaggtgcaaagtggaaaagcagccagacc

SEQ ID NO: 82886 - DNA, 201 bp, Homo sapiens
ctcctacagccatgggggctttgggtgagcaaaactcttcccgactccccttgcattctcccacctggcactactcaggcagttccctctgcctctgcacmcttctccactgctcacaacttagcttgtctttttagttccagctcaaatgctgctccttcccgagacttctgggttctgccctccaaatttcctatggtc

SEQ ID NO: 82887 - DNA, 201 bp, Homo sapiens
gggctggctccagtgtcacggaatgtccagtctcttacaccctgggtcacttgccaccttctctcccctgtctttgcagccaacctcggtttgaagtccakggcagtggctcctgcggagcagccagcataccaggggccagtgcactgcattacaaccattgtgaggaatgagggcctggcggggctataccggggggcc

SEQ ID NO: 82888 - DNA, 201 bp, Homo sapiens
taggttcagaaccctcagaggtccaggtagaactttagaagtagattggagatgggaacctatcattacctgatgatgcacatgggtgtgaggactctggsgctgttgggaccttcctggcattgggattatccaagccccttgttctgggatgttccctagaaaggggaaggggctcatctcagatcatacaacaagtta

SEQ ID NO: 82889 - DNA, 201 bp, Homo sapiens
tgtgtctgaggaaggcacagtgactttctgtggctgggtccctgggttctggaaaaggggcaatagtggtagagctggtgtctcctgtctgtgtccagccsagctcagcccttctgaagttggatgtcccctaagagatggctgtattggtacctgttaggattggccaaacctggacctacaaccaccacaccccaaaat

SEQ ID NO: 82890 - DNA, 201 bp, Homo sapiens
gctggctggtgtaagccaggagtccaagggctgagttactaggcattcttttttgatccacaggtgcagccagtgtcatcgtcggccaccctctggacacrgtcaaggtacagtagccatgtttcccattacctcttaaaaagaggcatggagctgacctgcctctgggactattcctgctgtttctaatctctcagagag

SEQ ID NO: 82891 - DNA, 201 bp, Homo sapiens
aaacccaaactgaggatgttacagccagcctgtctgctggaggatgtacagccatgttactgatgcttccatcaaatctaagcagtgctgtaggtgggacyctgattttggaatttcctttaatatctaaagcctctgacccaaggatcagtcagggccagacttttgatgaatgccaagggtgtgagtcttgggagtgct

SEQ ID NO: 82892 - DNA, 201 bp, Homo sapiens
tgtggtgtaaagacagcataggtggttgacctcaaattggatttcaggggtctttacacacacacacacacacacacacacacacacacacacacacacacacccctattaagtggccctaaatctctgcattagagaaagccttttctggggactctttgaggcctaaaattgtatcattatccttttaggttgtctttc

SEQ ID NO: 82893 - DNA, 201 bp, Homo sapiens
tagcacctccctggtggggctgtcatgaagcttgttcatggaggtactgaggatacagcaatgagcgagatgatgctactatcaagaatagacaggctggrgtgcagggaggcagacagtcacttgtctagggtccggggactcacctgtggaagaacccggctacaagggcctgtgctgctgacccaggtgaaaggctta

SEQ ID NO: 82894 - DNA, 201 bp, Homo sapiens
  misc_feature (1)...(201): n = A,T,C or G, or insertion/deletion polymorphism (see Tables 1-2)
gagggagaaagaaaatggggttgctttctggccctagtcatgcagggagtggatctctgtggagtttctttctctctgtaatggccagtagctgccctgcnctctcccgagtgtagaatgcaaatgtgaatggcagcacactgcaaatggtgctctgaagtgcgaaggccaggaagaagggatggcctggatcctggccac

SEQ ID NO: 82895 - DNA, 201 bp, Homo sapiens
atgtggtgtaaagacagcataggtggttgacctcaaattggatttcaggggtctttacacacacacacacacacacacacacacacacacacacacacacacacccctattaagtggccctaaatctctgcattagagaaagccttttctggggactctttgaggcctaaaattgtatcattatccttttaggttgtcttt

SEQ ID NO: 82896 - DNA, 201 bp, Homo sapiens
gccacagacactcattgccagcctcatgggtattataattttttataaaattattttttaaaaaagaaaccccatttcctttctccctcagtttcttcccygatggtgacctctcagagcactttcctttgcagtggggcatgcagatgagctatgttgatagcatttgctaactcctgggagacactcatgccagcagct

SEQ ID NO: 82897 - DNA, 201 bp, Homo sapiens
ggacagcagcatttcctattctcagatgtccgcagagccagcctcaacccgcaggttgactctgatggaaagaagcacatatgattttcaagctgatatcrccgcggcccagaatttcagacttctgtggacccacaggaccttgtcaggaaagaaaggatagagggcagcccagggcactgggatggtattggggaaggg

SEQ ID NO: 82898 - DNA, 201 bp, Homo sapiens
tgtcatcggatgggtggatgaccaacccccatatgccctcaggcctcctcttcctccctgtgttttttcttcctcattgtctggccccataccggctaccygcaaagctcagaagacaaagtaagtgtggactgaactttctagtcaaccaagaagccatttgacatcagtcttggttagcacaaattctcctgggaagga

SEQ ID NO: 82899 - DNA, 201 bp, Homo sapiens
agaagaagaaagagagggagagagagggcaatttaaaaagcatatgtaggtgtttgcctggcccaacagcttacctatagtatttagtgcatgtgtatcarggtctgggaggaaaagcaccaccaggcatgacgcgggtcagggcagggcatgactgggacttccctgtgtggtctctgcctgcacaggtcctttgggctc

SEQ ID NO: 82900 - DNA, 201 bp, Homo sapiens
gctgtccctacctttgcactaatggtgcctggcacagagcccagcacacaaagggccactcagcagtgtcatcggatgggtggatgaccaacccccatatsccctcaggcctcctcttcctccctgtgttttttcttcctcattgtctggccccataccggctacctgcaaagctcagaagacaaagtaagtgtggactga

SEQ ID NO: 82901 - DNA, 201 bp, Homo sapiens
ctgttctctgccacttttgggatgtcctgtgaagcccctgctacagggattgggcatggctgggtgctctgtctactcagggcttctagattcccgaggasagagagagagagagagagagagagagagtgtgtgtgtgtgtgtgtgtgtgtgtgtgtacatgtgagagaagaagaaagagagggagagagagggcaattt

SEQ ID NO: 82902 - DNA, 201 bp, Homo sapiens
tgtcccgccgtctctctcacccctaggtctttgctcaggctgtcccctctgcctgacatcctcttctcgctcctttcctacttgtccttggcttcaccagytctttgccatccaggctgtagaagtctcctcctccaggatgccggcttgctttctcagctagggtgagtcgcgccttctgcagaccatcccccaccccca

SEQ ID NO: 82903 - DNA, 201 bp, Homo sapiens
aaactcactgtgaattcatggaagagctggagttggctctaagtttcaaaataaaagcattaaaaacctcttcacattgtttctctgtcagatgcctctgyctagcttccaagaggcacctggccactgtcattcctctctctctgttcaggcctctgtgggtgttgcaggcccagagggaaaacccctccacacaggtga

SEQ ID NO: 82904 - DNA, 201 bp, Homo sapiens
cctgcaccaactctgataccacagtgcccagagactgaggaaactggggaaatgaaaagggttggtttctacctttacaaaatgaccacttctgtttcttwaacttagaaaattatacaggaatcagagtaggtttctatctgtgcctgacagttctcaagtcatttacgtttgtgtgggaacttgcttttaggtggtcgt

SEQ ID NO: 82905 - DNA, 201 bp, Homo sapiens
gtaggaattctgtcaatgcataatgctcatggattgtggggtgccttgaaatgactcccactggctgagccttactggaatagaaccctcgtgaaaacccrcacatccctgactagtgacccatagggcctcatttgtggatggctgatttgtgaaggattttctgtagaaagtggcctcttgagaaattatgctgtgttc

SEQ ID NO: 82906 - DNA, 201 bp, Homo sapiens
ctgaacagctcgagggcttggctgagccacttgttcatctctagggatccttgtccatcagcccctttcccagggacatgttgcaccctggaggctgctgygaggtgctggcacctctcctgaaggaaggccacctgatatcctagccagtgacagaggcctgcaccaactctgataccacagtgcccagagactgaggaa

SEQ ID NO: 82907 - DNA, 201 bp, Homo sapiens
gcaaccctcagatggtcctcatagacattctttgtaactgctccctgcagccctcctgcagctccagccacagcctatgagcctgagggtctgtattcagyatcaggagtcttatcacagagactcctacaggagtctctgatctattcttccccttaacaacacttgtagctttctttgttctgagcagcaagaaatgaa

SEQ ID NO: 82908 - DNA, 201 bp, Homo sapiens
gtgggacatggctgagatgaacaaaaaggcatcactgcccagagttgggatgggagagagtccacagctgattggaatcagcattgtcagcacagcacagyacagggagatacgcgcattgccgtctctggatgggcggctggcactttcagttcaaaggcgctgaggctctgaagttggcaaggaagaggataacccgga

SEQ ID NO: 82909 - DNA, 201 bp, Homo sapiens
ttagacaaagagtgatcaatttgagaagaaatgacaggacaaagaaaatctggctagggtggtggaattttgctagaggagtcactaggagatgtgtgggkggggggtataaaacaggtggaagataaggattacttcattaagtatgaattcagggccactgcagccttcagttctgaatcccagctaataagggctatt

SEQ ID NO: 82910 - DNA, 201 bp, Homo sapiens
tttctttccaattggtctatccctcttttctcagctattaggaaagggggaagtttgagggactttgctaattgtaaaaaaaaaaaaaaaaaaaaaaaaaagtctttctttggacccatctaaaagggttatcctaaaagggatgttggcaaatgtagcccctcaccaaaggggtgaaaaaataagatgaaaagaacaaca

SEQ ID NO: 82911 - DNA, 201 bp, Homo sapiens
tgattttccctacttcatctcacaccacacctcaaatattatgtgttacctaaactcacccctgccactaccacagcataactgaggaaaaactccagttktgtgtaacctctgtggagaaatcctgaagaatctggagctgcagtgtggaaaattcctgcaaaaacaaggtgatggctcagtttttcacaaaggaatgag

SEQ ID NO: 82912 - DNA, 201 bp, Homo sapiens
cacactgaaagagtctatgtagtatggtaaaaattaagcttccagaattagactacctgcttataattctacttccactgaacccaaaaaaggttagacarctcacctaatgtcaccaagcctcagttaactcatctgcaaagcaggcataactatagtagctactttatagctgggatgcaatgaaatgtattatacatg

SEQ ID NO: 82913 - DNA, 201 bp, Homo sapiens
gccatgtccttcctagaagttcatggctaatgacactcactcctcccccatctgggagtgtttagatctgtttttccattgaaagactaattaatgtgcakatcacaaagccctccacataacaggaggttggagttgggaggatcagggaaggactgaacattaactctgtgctgactatcctaatcattgcaccaggcc

SEQ ID NO: 82914 - DNA, 201 bp, Homo sapiens
catgtggtgtaaagacagcataggtggttgacctcaaattggatttcaggggtctttacacacacacacacacacacacacacacacacacacacacacamacacccctattaagtggccctaaatctctgcattagagaaagccttttctggggactctttgaggcctaaaattgtatcattatccttttaggttgtctt

SEQ ID NO: 82915 - DNA, 201 bp, Homo sapiens
aatctcatatacattttgctccgccacactgtgcataaataaatgtgtacacagacacacacacacacacacacacacacacacacacacacacacacacagcatgttggattttctagcttcaaagaagagcttagtgtggcttgtcataattgattctagacattctgaagtcacatttgcttcgaaagaagtagtggt

SEQ ID NO: 82916 - DNA, 201 bp, Homo sapiens
aaatctcatatacattttgctccgccacactgtgcataaataaatgtgtacacagacacacacacacacacacacacacacacacacacacacacacacacagcatgttggattttctagcttcaaagaagagcttagtgtggcttgtcataattgattctagacattctgaagtcacatttgcttcgaaagaagtagtgg

SEQ ID NO: 82917 - DNA, 201 bp, Homo sapiens
aaattgtcttccacaaaactggttcctggcgccaaaaatgttggggatcactcttgtagaccactgggactggactgcaatggacaggctttgggaggggstgtctgcctccttctcatgaacatcccagtgggggttcttgttttgcttcaacatgctccccacaattctaggctgccccctcactacccagtccagtct

SEQ ID NO: 82918 - DNA, 201 bp, Homo sapiens
agaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttcaaggtttgacaggtgtttttgcaacatct

SEQ ID NO: 82919 - DNA, 201 bp, Homo sapiens
cagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttcaaggtttgacaggtgtttttgcaacatc

SEQ ID NO: 82920 - DNA, 201 bp, Homo sapiens
ccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttcaaggtttgacaggtgtttttgcaacat

SEQ ID NO: 82921 - DNA, 201 bp, Homo sapiens
cccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttcaaggtttgacaggtgtttttgcaaca

SEQ ID NO: 82922 - DNA, 201 bp, Homo sapiens
aaagactcttcaagtatgtaactcacccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttca

SEQ ID NO: 82923 - DNA, 201 bp, Homo sapiens
taaagactcttcaagtatgtaactcacccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttc

SEQ ID NO: 82924 - DNA, 201 bp, Homo sapiens
cacatttgatttggcacgcgtgtgctgccctgactcctccaagggcctgtggaattttccggttttcctcagcacatctgtggtgttcatcaagaatgccstgtggaagggaccgaacccggcctgcagcaccccctcctcagcctcctgcagcctgtgtgtgcgcatcctgtgtccttatgtggccccttcagccacttc

SEQ ID NO: 82925 - DNA, 201 bp, Homo sapiens
ggctcttcagctgaatataaaaaccaaattgacaccagactgattaacaagagaaaaataatacagattttattagtttttcatgacatagggatcttcayaagagagtgaagttgggagaagtggccaaagcaagatcttttcatactttttagacaaagagtgatcaatttgagaagaaatgacaggacaaagaaaatc

SEQ ID NO: 82926 - DNA, 201 bp, Homo sapiens
cctgtcgcatcagcaccctcttcccctctcttcatggacacatgggcagatgtgtccggtggtgtaccccgtcagcctgcaggctctgcgacggcagcccsgggtcctcacgcctcttccttctggttttcactgcagatgttcggcttcttcaagggcatgtccttccccctcgccagcattgccgtctacaactccgtg

SEQ ID NO: 82927 - DNA, 201 bp, Homo sapiens
cccactccccctaccccagcaattgaccgttgactaaacaagtgcctgttttgtcccaagagctggctggtgtaagccaggagtccaagggctgagttacyaggcattcttttttgatccacaggtgcagccagtgtcatcgtcggccaccctctggacacagtcaaggtacagtagccatgtttcccattacctcttaaa

SEQ ID NO: 82928 - DNA, 201 bp, Homo sapiens
aaatgctggttgcaaggagcctgagccagcctcagcatgggctatggaggttcatccaggtgagatacagctagccccagagatgggcctttcatccactygcagagcagcagcaggactgaggactgcctctagcctgtagacgccactgcccacagaatcatggcctagcccctttccttggcattcagggtcctcagg

SEQ ID NO: 82929 - DNA, 201 bp, Homo sapiens
gatcgtccttaccttccaaaaaatagaggaagaattaaggcctggactttcccaagatgcccagagaggcagcagcagcactaggaccagagcccaggcakcccagctttcccgccagctgcttcaccccctcacttcacagccacttacctctgcttcttgactgccagcctcaagctgaacaggtgatgggccagattc

SEQ ID NO: 82930 - DNA, 201 bp, Homo sapiens
gctctgtgggggaaatgtggctggtacctttgagggcctgaaagaagccgggcttctgtgatgctccaggaaaggccagggggagtcctcacacctgggartgatgtgaccacctcttcagctctgtcttgtatccagacaccctccttgtctgccagccaccagcaggaccttcagacttttccccatgtctcctcattt

SEQ ID NO: 82931 - DNA, 201 bp, Homo sapiens
cctgtgaagcccctgctacagggattgggcatggctgggtgctctgtctactcagggcttctagattcccgaggagagagagagagagagagagagagagwgagtgtgtgtgtgtgtgtgtgtgtgtgtgtgtacatgtgagagaagaagaaagagagggagagagagggcaatttaaaaagcatatgtaggtgtttgcct

SEQ ID NO: 82932 - DNA, 201 bp, Homo sapiens
aagaaagaaagtaaaaatgcagagagattcttgagggcaagtgggaggaagttgagggaattgatgtcagaagccctggctccatcatactgaagaccatmtggatagaaaggaatcagagtggggccaggatttgaggtgaagaaggttctaatttctggacatgacaagagcagacaagctgggctggatggtaacagc

SEQ ID NO: 82933 - DNA, 201 bp, Homo sapiens
aaaaaggcatcactgcccagagttgggatgggagagagtccacagctgattggaatcagcattgtcagcacagcacagtacagggagatacgcgcattgcmgtctctggatgggcggctggcactttcagttcaaaggcgctgaggctctgaagttggcaaggaagaggataacccggagaagggaggactaagagaattt

SEQ ID NO: 82934 - DNA, 201 bp, Homo sapiens
cagggtaggggttattgatgttaagatccctgaagggacacacaacccttaaagatgaaaccttatgtagaaaggcaggaacccttggagcatgaaaaggracccaaaatcctgaagacaacccaggcctgtatagcctgggccttctcaagtaggctgtgggttgccaacagcaagtgagagctggagcaatggcagccc

SEQ ID NO: 82935 - DNA, 201 bp, Homo sapiens
gcctcaccaatggtggtggtgtggtgcatttttatctcaggtatatttatgcttggaattataataactacctttgatgacattctgctctgtggacccartatgaatcatccataccactattggtagtgctagtgctgatggacttgtaagttacaaccactgccccagagaaaggttgcttctcaatgagtgacacct

SEQ ID NO: 82936 - DNA, 201 bp, Homo sapiens
ctctgtggacccagtatgaatcatccataccactattggtagtgctagtgctgatggacttgtaagttacaaccactgccccagagaaaggttgcttctcratgagtgacacctcatgatatcacagagttgttttaccttgaaaatcaggagaggatagttaggctgtggaatcactgctctccctaactgggctgtaaa

SEQ ID NO: 82937 - DNA, 201 bp, Homo sapiens
gtaaagactcttcaagtatgtaactcacccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagtt

SEQ ID NO: 82938 - DNA, 201 bp, Homo sapiens
ggtaaagactcttcaagtatgtaactcacccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagt

SEQ ID NO: 82939 - DNA, 201 bp, Homo sapiens
ttgatgaatgccaagggtgtgagtcttgggagtgctgagacctgcctaagtcaggcgctccattgtccatggagtagatgctgagatatatatgggactcrggccatagtgtatgattcctgtcatcaggaaactcaccgccacactaagggcaaaacaacacactcagaaaacagtagcaacagaggcaagccatactag

SEQ ID NO: 82940 - DNA, 201 bp, Homo sapiens
cctttaatatctaaagcctctgacccaaggatcagtcagggccagacttttgatgaatgccaagggtgtgagtcttgggagtgctgagacctgcctaagtyaggcgctccattgtccatggagtagatgctgagatatatatgggactcgggccatagtgtatgattcctgtcatcaggaaactcaccgccacactaaggg

SEQ ID NO: 82941 - DNA, 201 bp, Homo sapiens
agtaattggggaagtttgcatatcttgtgacctcctaaataatggctggcaatcctttatgtctataccttagcagaattcaggctcctctcctccatacyttagcagaattcaggctcctctcctccctctagcctgttgacctctcattacttttagggaagggcgattatcatttaaagtataaactaaatgtctggc

SEQ ID NO: 82942 - DNA, 201 bp, Homo sapiens
ggagtcaaggagggtttgggagcagggtgggagaagggctgggaggaaagcctggaggtcagggctgtgcacctgcccaggtagtgctgagggccactcargtctgccttgcctaggtatgggagcctgagatatggcctacctggggaccttcagatctctcatcagggaagtccttaaagggatccttaaagggcctta

SEQ ID NO: 82943 - DNA, 201 bp, Homo sapiens
ctgtcaggctggagtcaaggagggtttgggagcagggtgggagaagggctgggaggaaagcctggaggtcagggctgtgcacctgcccaggtagtgctgarggccactcaggtctgccttgcctaggtatgggagcctgagatatggcctacctggggaccttcagatctctcatcagggaagtccttaaagggatcctta

SEQ ID NO: 82944 - DNA, 201 bp, Homo sapiens
aatattatcatgagattgcaccattcagccccatcttcagcctctacttctcattctagttctcttgctttctccatcacatctacagttccttcctccatggaagccttgaagctcttgaaattatctgtgagggttggggttaactacttccaaactcttgttaacattgctattttgacctcctcccatgaaccccaa

SEQ ID NO: 82945 - DNA, 201 bp, Homo sapiens
actttttggtttcccagtgcatttaaagttatgtttagactatactgtagtctaagtgtgcaatggcattatgttttaaataagtatatataccttaattwaaaaatactttagtactaaaaattattgacaattatctgagtattcagcgagtcgtaatctttctgccagaggagggtcttgcctcgatgttgatggctg

SEQ ID NO: 82946 - DNA, 201 bp, Homo sapiens
aaatattatcatgagattgcaccattcagccccatcttcagcctctacttctcattctagttctcttgctttctccatcacatctacagttccttcctccatggaagccttgaagctcttgaaattatctgtgagggttggggttaactacttccaaactcttgttaacattgctattttgacctcctcccatgaacccca

SEQ ID NO: 82947 - DNA, 201 bp, Homo sapiens
ttgtgtatctccaccagaactcttgggtgaccaggtgcattgtcaatgagcagtaatattttgaaaggaatattcttttctgagcagtaggtctcaacagyggacctaaaatactcaggaaaccatgctgtaaacagatgtgctgtcatccaggccttgttgttccttttctagaacacacagagcagattgattgtcatt

SEQ ID NO: 82948 - DNA, 201 bp, Homo sapiens
taggaagtgatctcccgtatttaaaggggatgccatttttccacagtgacatcccctggaggagacttcctgtatgttacatccaggaaacatgagggctstgggccctgaaatagtcggctctgaatgttcttttcaacgggtgcttcccggcttcaaggcttgtaagtctgaaagtgcagagtgaggaaaagccttttc

SEQ ID NO: 82949 - DNA, 201 bp, Homo sapiens
gttgtgtctcaggaaacagggcagcctgaggagagggagagagatagggaatggctggcttgtcagtggagcagtcagagcaaccatgattaagctgactstcttatatggacacagcttgttgtacccccaaacaatgacattagtagcatcaaagatcacagatcatcataacagatataatgattatgacaaggttga

SEQ ID NO: 82950 - DNA, 201 bp, Homo sapiens
gctaagtttatggatattctaaatcctttgctgtcattttaacaacattcacagaatcttcaccactagtagatttcatctgaagaaaaactgtctttctyatccataagaagtaactcttcatccgttaaatattatcatgagattgcaccattcagccccatcttcagcctctacttctcattctagttctcttgcttt

SEQ ID NO: 82951 - DNA, 201 bp, Homo sapiens
gcgggtcagggcagggcatgactgggacttccctgtgtggtctctgcctgcacaggtcctttgggctctggtgggggaccgggcctgggtaggcagcaccwctagctattctctgcccctccttggtggccctgcagagagtgtgggtcagtcccctgcaataacctggcccctgtgcaaaggtgtttttcagaggcatca

SEQ ID NO: 82952 - DNA, 201 bp, Homo sapiens
gcctgttttgtcccaagagctggctggtgtaagccaggagtccaagggctgagttactaggcattcttttttgatccacaggtgcagccagtgtcatcgtyggccaccctctggacacagtcaaggtacagtagccatgtttcccattacctcttaaaaagaggcatggagctgacctgcctctgggactattcctgctgt

SEQ ID NO: 82953 - DNA, 201 bp, Homo sapiens
aaaagcaccaccaggcatgacgcgggtcagggcagggcatgactgggacttccctgtgtggtctctgcctgcacaggtcctttgggctctggtgggggacygggcctgggtaggcagcaccactagctattctctgcccctccttggtggccctgcagagagtgtgggtcagtcccctgcaataacctggcccctgtgcaa

SEQ ID NO: 82954 - DNA, 201 bp, Homo sapiens
aagcccacagcaggcctgcggggtcagtgtcagtccctggaaggtggttcacacatttagggggatgtgggactatagagaagggaatcaggagaccaggrggctgctggtgattatgtatcaggtgccacaagtgggtgctttgtcaagcacttcacctgggtggtcttttcacatggccagtggaggagataggtatgt

SEQ ID NO: 82955 - DNA, 201 bp, Homo sapiens
cctctggacacagtcaaggtacagtagccatgtttcccattacctcttaaaaagaggcatggagctgacctgcctctgggactattcctgctgtttctaayctctcagagagtcttctgcccagggcagactctctgttgccagtccagggggtgttgggtgccaggaggtctggtttaggttcagaaccctcagaggtcc

SEQ ID NO: 82956 - DNA, 201 bp, Homo sapiens
gattatctgatggtttcacctcaaaaccatcaccccaccctggtctttggaaaaattgtcttccacaaaactggttcctggcgccaaaaatgttggggatyactcttgtagaccactgggactggactgcaatggacaggctttgggagggggtgtctgcctccttctcatgaacatcccagtgggggttcttgttttgct

SEQ ID NO: 82957 - DNA, 201 bp, Homo sapiens
ccctgggttgctgtccctggggaatctggagccttcctgtcactccaggaaacctgaactgcaggcaccaggactctttcagttcagacgctcttcctttktcacgtccaaaattcatttattcattcattcatttactcatccatccatccattcactgattcaattaatgtgtttatggaaggtctactctgggcgaag

SEQ ID NO: 82958 - DNA, 201 bp, Homo sapiens
agacagagggggcatttgtaggtagacagcttctggaggcaccagggccagctgccctgggttgctgtccctggggaatctggagccttcctgtcactccwggaaacctgaactgcaggcaccaggactctttcagttcagacgctcttcctttgtcacgtccaaaattcatttattcattcattcatttactcatccatc

SEQ ID NO: 82959 - DNA, 201 bp, Homo sapiens
acctcttcagctctgtcttgtatccagacaccctccttgtctgccagccaccagcaggaccttcagacttttccccatgtctcctcatttaaggcccagckgactaagcagtgactgactgcccatcaggcctgcgccaggctctgcaggtccagtgcagaatgaggcagtaccctcttctcagtgggctcacagtctgga

SEQ ID NO: 82960 - DNA, 201 bp, Homo sapiens
ccttgtctgccagccaccagcaggaccttcagacttttccccatgtctcctcatttaaggcccagcggactaagcagtgactgactgcccatcaggcctgygccaggctctgcaggtccagtgcagaatgaggcagtaccctcttctcagtgggctcacagtctggatgggaagacaatcaaccactgagtctgacagcag

SEQ ID NO: 82961 - DNA, 201 bp, Homo sapiens
gctcacagtctggatgggaagacaatcaaccactgagtctgacagcagagatacagatatgctcagaatattcaggaaacacagatgagatctagaagatmccatgtggcatagggtgatgaggaaggccttcaagaaaggcctgtcaggaggtgacagctgaactgagtcttaaagaagaagggggcagggattagccag

SEQ ID NO: 82962 - DNA, 201 bp, Homo sapiens
gtggcccacagctcctgcagggcccggggctgtgggacagaaggctcacactccaagctgggccctggctgcctccgccttgcagagcagagccaagcccrgacccacaggggaacctctgtgggcaccggcatggaattttcctctcagagtttgacccagttcctggctgttattcagtcactctggatgagcctgtgg

SEQ ID NO: 82963 - DNA, 201 bp, Homo sapiens
agtcagttgtgttcatctgtaagatgggaccagtatccgtgccttagagcatctgtgggatttagtgaggtcaattttatatgatggtcagtatgcagttrgtgcataataaatgccttctcctgctatcactgggggccctagagacttgggctttgctgctggcctcagtgccagcctacccgagtgctcagcatgcct

SEQ ID NO: 82964 - DNA, 201 bp, Homo sapiens
ttgactcctggtcaggtcactcttacctggaaatgaatggggcttaggcaaagtttagacactgggacaattatatcgattcagttgaattgaacacacaygagtgagaagggagggaagtgaagagagtgggagagagaacccacaaacaataagcaaatgagcttatttgcttattgttagcaatagataaatctgggt

SEQ ID NO: 82965 - DNA, 201 bp, Homo sapiens
acactgaagttggcctaatggatatggcaggggtttactcccttccccactggaagatggaaaatacagcatgggtttgttcaagcatacttcccaggcaygcagaaaccaccccctcaacctcacctgcttctgggatgagttaaagtacagattacactttattctccaatctctagactgtggagtcatgaagccgaa

SEQ ID NO: 82966 - DNA, 201 bp, Homo sapiens
tccacagtgacatcccctggaggagacttcctgtatgttacatccaggaaacatgagggctctgggccctgaaatagtcggctctgaatgttcttttcaaygggtgcttcccggcttcaaggcttgtaagtctgaaagtgcagagtgaggaaaagccttttcacaccagctaatgggatgtgacaattgaatgcagctggt

SEQ ID NO: 82967 - DNA, 201 bp, Homo sapiens
ctttattctatttctttcctggtcatgtcacattatgttatttcctggagaagggaaagtcaagaacaagagcctactttatctgcactgggtctggaagktctgtctggtcatgagtcaaagcctcatagtagagaaggatccatagcagagaagggtccgtagcagagaagacaagcatcagagtgggagatgggtagc

SEQ ID NO: 82968 - DNA, 201 bp, Homo sapiens
ctgggtggcttaaaacagtagaaatttatttcctcgcaagtcaggaagcaggaagtccaaaaccaaggtgttgatgccttctggaggctccgagggagaayctgccacatggtcctctaccagcttccagtgcctgctgcagtgctcggcattccttgggcagtggctctgtaactccaggccctgcctgtcttcatatgg

SEQ ID NO: 82969 - DNA, 201 bp, Homo sapiens
gtttcagtggatctcactttaattatattacttctgattaaaattcttagatgtcttttatcaaccttgaactaccaattccaactttatcatccttttgygttcaaacagggttggcatcaccattcacatagaaatcaccaacaggaacatatcacatatgaaaacaaacttactggacacttgttgttctttagtact

SEQ ID NO: 82970 - DNA, 201 bp, Homo sapiens
taggacactgatggacaataattagggaacacaacagatgcacaaatcagttatggacagtggtaggtgctgggggacaataacacaaggtgatggcaaasacagtgatgagagccttctgtattttgaagagtcagggatggcctctctgccagggaggcagctaagttgagactcagatgacacaaagagccagatacg

SEQ ID NO: 82971 - DNA, 201 bp, Homo sapiens
gcaggcaggacccagtgctgggagatgggcacacaaagtggtgagtgaagcaggcttagtctaccctcctgaaatggtataatcttcccattttatatagsaggggggtaaggtgcagagtttaggaacctgccccagacctcagagccgggcattgtagtgctggattcaaagctccaaagtaaattttacttctgggct

SEQ ID NO: 82972 - DNA, 201 bp, Homo sapiens
tggtgttccccaagctctctttttgccttctgccatgtaagacatgacttgctccttcttcaccttccaccatgattgtgtggcctccccagctatgtggractgtaagttgattaaacttctttcctttataaattacccaggcttgggcatgtctttgatagcagcatgagaacaaactaatacaaagggcttcttaat

SEQ ID NO: 82973 - DNA, 201 bp, Homo sapiens
aagagagccaccatcctccagaccacagaatggtagatccacttacagcttgcaccatgcacctggaaaagccacagacactcattgccagcctcatgggyattataattttttataaaattattttttaaaaaagaaaccccatttcctttctccctcagtttcttccccgatggtgacctctcagagcactttcctttg

SEQ ID NO: 82974 - DNA, 201 bp, Homo sapiens
tgtgagaagagagccaccatcctccagaccacagaatggtagatccacttacagcttgcaccatgcacctggaaaagccacagacactcattgccagcctyatgggtattataattttttataaaattattttttaaaaaagaaaccccatttcctttctccctcagtttcttccccgatggtgacctctcagagcacttt

SEQ ID NO: 82975 - DNA, 201 bp, Homo sapiens
gtgctctgtgtcctagccacttcagccatggctgaaaggggccaaggtacagcttgggctgtggcttcagagggtgcaagccccaagccttggcagcttasacatggtgttgagcctgtgggtggatagaagtcaagaattgagctttgggaactgccatctagatttcagaggatgtatgaaaatgcctggatgtccagg

SEQ ID NO: 82976 - DNA, 201 bp, Homo sapiens
cccagctctgagtaacagcccctgccacaccccctccccccgccctcctccatgctgggcagacaatgcctcagcacatcttctgcaccttcactcccacycaggagcacctgggctgcaatgaatgaaactcggctttattgaagaaactcagctccagcccaaacaaatctcatgaggtagccagatctgggaggggtc

SEQ ID NO: 82977 - DNA, 201 bp, Homo sapiens
ccaccccccccccccacacacacacacattttgtttgagattttactggtttgtgaagtgccaaggtctggaaatcactgaccttataatcccatttttttaaatctcaaatcccctgctttcagatgggtgggctaataagtggcagggagatgttggcccaaggctggatctaagcctgccctgagctgaaggatgtgt

SEQ ID NO: 82978 - DNA, 201 bp, Homo sapiens
gtgctttattctggtccttactttggtgatgttattgaaagtaatggcaaaaatcgcaattacttttgcaccaaactaataacatggctttttttttttttggcttccatgaaatgatggtaagtgtttactacacttgaatacttactaggtgccaggtatagtttaagtgctatatgtattcttttaaaacaattttat

SEQ ID NO: 82979 - DNA, 201 bp, Homo sapiens
ctaagccaagcatggtgcttgtgtgaacacactggtctcatctgcacgaagctagccccagctgagctgggactcatacgcatgtatgtctcatccaaaarcccagagtcccgatctcacctggcccacatgccaggaagtgcagcaggcgaggccttgctcctgaccacctgtctcctgcccttacccacccttgcctgt

SEQ ID NO: 82980 - DNA, 201 bp, Homo sapiens
acttttttttttttttatcatgagaatgttgtggccttctgaaatgtcctgttgtttgtcacatatctaatctgtggtaggctggggctgccacccttttygtcaccaaacagcagttcagaaatgcccaccagtgactggtggtgtgctgggtccccagggaccaagtctggcacagaatatacctgtttccagacagct

SEQ ID NO: 82981 - DNA, 201 bp, Homo sapiens
tgtgctttattctggtccttactttggtgatgttattgaaagtaatggcaaaaatcgcaattacttttgcaccaaactaataacatggctttttttttttttggcttccatgaaatgatggtaagtgtttactacacttgaatacttactaggtgccaggtatagtttaagtgctatatgtattcttttaaaacaatttta

SEQ ID NO: 82982 - DNA, 201 bp, Homo sapiens
ggtaattatatgggcattgaaaaacccttgaaggatacacaccaaatttaatagtggctatttctgggatgtgggattgggagaaggctttcagttccgamtttgatgttggtgatttctttgtacatcactataatgatggtgatttgatgatggtgattattgtaatgttttaatttttttacagcacacatatattgt

SEQ ID NO: 82983 - DNA, 201 bp, Homo sapiens
aaaggttagacaactcacctaatgtcaccaagcctcagttaactcatctgcaaagcaggcataactatagtagctactttatagctgggatgcaatgaaawgtattatacatgaagacctcagcacaatgtctggcatatagaaaatgtgaaataaatgttaattatcagtaaatgtattatttaacaatcttcctaatgg

SEQ ID NO: 82984 - DNA, 201 bp, Homo sapiens
tcttccacaaaactggttcctggcgccaaaaatgttggggatcactcttgtagaccactgggactggactgcaatggacaggctttgggagggggtgtctrcctccttctcatgaacatcccagtgggggttcttgttttgcttcaacatgctccccacaattctaggctgccccctcactacccagtccagtctggggca

SEQ ID NO: 82985 - DNA, 201 bp, Homo sapiens
cctgaggctacacttccctgctgtccagcccagggtacatcgccagcagccatgatgatggctattttacggtgtaaaaaagacaaagttgttgggacacrtaagtatggcgtctgaaactgctattgaaggcctcccatcaaccacatcagaactgcccttctggacccacctcccattgctctggtccaggttccctgt

SEQ ID NO: 82986 - DNA, 201 bp, Homo sapiens
ggggtgtctgcctccttctcatgaacatcccagtgggggttcttgttttgcttcaacatgctccccacaattctaggctgccccctcactacccagtccartctggggcatgcatcttggcccaggacagccagggcatggcttgctctgccaggtcaggggcaggccaggcagtggctcagctctgagctctgaggcttc

SEQ ID NO: 82987 - DNA, 201 bp, Homo sapiens
attaatcatcatggcacctcttgatggtagaaggaggcatgcagagagaagcattgctgatccagttcacagatgaaggaactgaggctccaacatacctragccccagctcaggactttaccaccaatcccatttgataatcttcctgaggctacacttccctgctgtccagcccagggtacatcgccagcagccatgat

SEQ ID NO: 82988 - DNA, 201 bp, Homo sapiens
gctttagccttacatgtgacattaatttgttgttgttgtttttgagagaatttatttccatacgagttgtgtacttaacattagttttaaactacataaaytaaaaataatgaaagtaacatctgcttatcgtaggaaagttggaaaatacagaaaagtcccatgcaggaaaacatcgcctgtgatcttcacctctgagat

SEQ ID NO: 82989 - DNA, 201 bp, Homo sapiens
ggggtcttctactgggtgctcctgatgaggctgagatgcaacaaccaccttcttcaggtgtctgagcttttcctagtttctattaatcatcatggcacctyttgatggtagaaggaggcatgcagagagaagcattgctgatccagttcacagatgaaggaactgaggctccaacatacctgagccccagctcaggacttt

SEQ ID NO: 82990 - DNA, 201 bp, Homo sapiens
aactggggtcttctactgggtgctcctgatgaggctgagatgcaacaaccaccttcttcaggtgtctgagcttttcctagtttctattaatcatcatggcmcctcttgatggtagaaggaggcatgcagagagaagcattgctgatccagttcacagatgaaggaactgaggctccaacatacctgagccccagctcagga

SEQ ID NO: 82991 - DNA, 201 bp, Homo sapiens
acagctgaactgagtcttaaagaagaagggggcagggattagccaggggaggagggagagggtgttccccacaagggaatagcatgtgcgcagtcacacayatgcacagaatgtgagacattgaggtgcaaagtggaaaagcagccagacccagtcctactgagctacacacaacacactggggaattggaatttatgctc

SEQ ID NO: 82992 - DNA, 201 bp, Homo sapiens
ctggcacctggttcatccctgggtagacctgaagtctctgctctaacacatcctagaatgtgtttcttaagtctgcctcaactggaccatttcccggtgcraggcatgcttgcacagtttgtttagaagtggtgctgtgtccacaaggccaactggggtcttctactgggtgctcctgatgaggctgagatgcaacaacca

SEQ ID NO: 82993 - DNA, 201 bp, Homo sapiens
ttgaggtgcaaagtggaaaagcagccagacccagtcctactgagctacacacaacacactggggaattggaatttatgctcaagatcacagaaagtcatcraagttcactaaactgagcagattcaaagtttcagaagctcactggggcagtaggacaggggcagagggacccaggaacccgtgtccactgtgatccaggc

SEQ ID NO: 82994 - DNA, 201 bp, Homo sapiens
ggactccagtggcatgtcattctggtgcattggagaggctctattgatgggagagaccagcctgcctgtctgccccagtatcactgggtctgggtgggcayggaggatgcgagtgaagagatgcttctggcacctggttcatccctgggtagacctgaagtctctgctctaacacatcctagaatgtgtttcttaagtctg

SEQ ID NO: 82995 - DNA, 201 bp, Homo sapiens
tccgccagcctcactcctcaccactgttctgaatgtcccgccgtctctctcacccctaggtctttgctcaggctgtcccctctgcctgacatcctcttctygctcctttcctacttgtccttggcttcaccagctctttgccatccaggctgtagaagtctcctcctccaggatgccggcttgctttctcagctagggtga

SEQ ID NO: 82996 - DNA, 201 bp, Homo sapiens
gggcgtagtggttgaacagggtgatgagggacagaaaccttctaggggttctcccaccctgagcagtggcacacgttggtgacttgcttcagagagtttgrccctgggcttggttggggtgggcactctctgggccttatttttacatggagaacaaaacaaaacaaaacacttgatccacagtctggcttccagagtgac

SEQ ID NO: 82997 - DNA, 201 bp, Homo sapiens
agagatgggaggtacgggtgggtgagggtccagatggggccctgaggaattcacacctaagcatgagaaggggccatggcaccagggaagaagatgagaasagctggagaagcaggaggaaagctgggtgagggcaggaatctggaagcagaggggagcaggcggcatgggcagcgccttcactgcagcaggtcaggcatg

SEQ ID NO: 82998 - DNA, 201 bp, Homo sapiens
agccctgccagggtgcacgggtggtgccagaacctggacaaagggagggggcctgaccaatcaggcagactgtagtcagcccaggacaagccccagaagckggcttcaaataaaatgctctccactttttgctaaagtggcaacattcacagcttctctggctatttgccctttcttataaaaggaaaagggtagcaacac

SEQ ID NO: 82999 - DNA, 201 bp, Homo sapiens
gtacctgctgaatgagtggccatctgggacctcagccaagttcaaggtgcctgctgcatacctctccagggctgggccttggggagacttggaagactcasatgcactccctaatgtctccatgagagtgctggttgttcctggcaattctcaccctcccaaactcacctaagtcattcccagtctgtcttctccagggtt

SEQ ID NO: 83000 - DNA, 201 bp, Homo sapiens
ggcagagccctgccagggtgcacgggtggtgccagaacctggacaaagggagggggcctgaccaatcaggcagactgtagtcagcccaggacaagccccaraagctggcttcaaataaaatgctctccactttttgctaaagtggcaacattcacagcttctctggctatttgccctttcttataaaaggaaaagggtagc

SEQ ID NO: 83001 - DNA, 201 bp, Homo sapiens
ggccaacagcttgtgagtcttcctccatcaacacattatggttctatttaaccaaatatatatatatatatatatatatatatatatatatatatatatawataaaatatatatatgtgtgtgtgtgtgtgtgtgtgtgagagagagagagagagagagagagagagtgtgtgtgtgtgtgtgtagtctgactgtggccag

SEQ ID NO: 83002 - DNA, 201 bp, Homo sapiens
cccaaagcccatcatcattccaatctgttctcaccttgctatggaggaagaagtttgtgacaggaaagagttagaaaggcattaataatgacgatggtgaycaatttgagtagctctttgtaaccaacttaggaatgatcagtggtgcagcctttgtggtggggaaaatcaaaagtccatggactcgtcgaggcatcccca

SEQ ID NO: 83003 - DNA, 201 bp, Homo sapiens
caggatatcatagcatgtgaggagaagctggaccctggttagtataagaagatgtgatacggaggaaacttgagttctgtctttatgttttaaggatggakaaactcaaagctttcctattctcattattttaaattccttttttaaatttttaacaagagctgctctgacagaagggtgaagcccagccctggtgcggcc

SEQ ID NO: 83004 - DNA, 201 bp, Homo sapiens
tgagatgaacaaaaaggcatcactgcccagagttgggatgggagagagtccacagctgattggaatcagcattgtcagcacagcacagtacagggagataygcgcattgccgtctctggatgggcggctggcactttcagttcaaaggcgctgaggctctgaagttggcaaggaagaggataacccggagaagggaggact

SEQ ID NO: 83005 - DNA, 201 bp, Homo sapiens
ctgcaggaatgaacactgcaggttatgtgacttttgcagaaaagcctagggaaagcaccaagctatgctggtgattaatctgcatcagtgagtggaagctygtctctgcccgtctcctctggcaagacattgcatttccgagttatattctgaaaccatcaccaaccatcagtatctgtccctgctgggatcctgcttggg

SEQ ID NO: 83006 - DNA, 201 bp, Homo sapiens
gaaggcacaggtttagagaggctcctggaggaccaagggcaggaggctgaggggaccagaggccaggataggctgagggccaagggcagtctaaggtctcytttgagagctactgcgcagcaattacaaaaccatgcaaaccagttgccctggactttaacatcaatttgtttttctctccccatctaggaatgtaccaat

SEQ ID NO: 83007 - DNA, 201 bp, Homo sapiens
tgctgagggatgtcccaggctattgcctctacttcatcccctacgtgttcctgagtgagtggatcacacctgaggcctgcacaggccccagcccctgtgcygtgtggctggcgggcggcatggcaggtaagggcagcagcagctggagccgcacccctgtgcaggccacagcagtgggacagctggggaactgccatgccc

SEQ ID NO: 83008 - DNA, 201 bp, Homo sapiens
tgtctttctcatccataagaagtaactcttcatccgttaaatattatcatgagattgcaccattcagccccatcttcagcctctacttctcattctagttstcttgctttctccatcacatctacagttccttcctccatggaagccttgaagctcttgaaattatctgtgagggttggggttaactacttccaaactctt

SEQ ID NO: 83009 - DNA, 201 bp, Homo sapiens
tgtacacagacacacacacacacacacacacacacacacacacacacacacacacagcatgttggattttctagcttcaaagaagagcttagtgtggcttstcataattgattctagacattctgaagtcacatttgcttcgaaagaagtagtggtattgacctaaagtaactggtgttctatcacgtggctgagatcgtc

SEQ ID NO: 83010 - DNA, 201 bp, Homo sapiens
cacggaatgtccagtctcttacaccctgggtcacttgccaccttctctcccctgtctttgcagccaacctcggtttgaagtccagggcagtggctcctgcrgagcagccagcataccaggggccagtgcactgcattacaaccattgtgaggaatgagggcctggcggggctataccggggggccagtgccatgctgctga

SEQ ID NO: 83011 - DNA, 201 bp, Homo sapiens
cggtcctgacatgcatgctgcaggtctcactagcctactttcggtttcaggaaaactgattttcaaggaaagaagacatagtgctcttatgatacctttgytgaacattttcaaatagccccggcaaccctgagagcctctgccagtctgtactttgcctcttactgcttcacaaacccagtctccaaatgggttgtttga

SEQ ID NO: 83012 - DNA, 201 bp, Homo sapiens
actgaataagaatggtcttggcagtagtggctgagtggccagtgtttactgaaccctaattgtgtgccaaacacaatgctaggagcttggcatatgtttartcttcacaacaacccaattcctggggatttactatggggagactgaggaacagagaggtttcatacccccaggtccctcccttagtgggaggtggaggag

SEQ ID NO: 83013 - DNA, 201 bp, Homo sapiens
ccgccagcctcactcctcaccactgttctgaatgtcccgccgtctctctcacccctaggtctttgctcaggctgtcccctctgcctgacatcctcttctcsctcctttcctacttgtccttggcttcaccagctctttgccatccaggctgtagaagtctcctcctccaggatgccggcttgctttctcagctagggtgag

SEQ ID NO: 83014 - DNA, 201 bp, Homo sapiens
aggaggtctggctggctgtcgcttcatattaacctggatgacgtgacatgaatatgcccagtgggacaagagcaggcccagcagaggccccttcctcctgmccatacccttcaccattcttgtcaaccttggggtgtcttggctgagacccacagctgagtccctgctggaaactagcagaacgctggggggcttcgagtc

SEQ ID NO: 83015 - DNA, 201 bp, Homo sapiens
tccaaagcttttatctgctctcatcattttctgggtcatgttgtcattgttcctgaaggggccttgtctctgctaatgggttataactgcttgagagttgraatcccatcacatttatgagccgacacacaacaccaagcaagaagattgagggaggaaaggaagatcataggcagtgtttgggaagcatcacataatact

SEQ ID NO: 83016 - DNA, 201 bp, Homo sapiens
agagagggagagagagggcaatttaaaaagcatatgtaggtgtttgcctggcccaacagcttacctatagtatttagtgcatgtgtatcagggtctgggargaaaagcaccaccaggcatgacgcgggtcagggcagggcatgactgggacttccctgtgtggtctctgcctgcacaggtcctttgggctctggtggggga

SEQ ID NO: 83017 - DNA, 201 bp, Homo sapiens
tcagacggttcaaggttaattgtttaaaatttgtattaatcagtcaaaaattggtaatgtatgaacataggaagcttccaaaactacatgaggatatactrtctcgatgccctgcctgtggtccctgtcctcgctcaaaggcaattaccgtaaagtttcttgtgatacatttcaaaaacatttacagtgtataaaagaata

SEQ ID NO: 83018 - DNA, 201 bp, Homo sapiens
gcattctgcctgggctcatagccctgtggtctgggattctccaggcctggccatggttgctggtaaacctagggtcctcccctcacttccctgggtgatgygccccatgggcaggtttgtggcatgcatatgggaatggagcacagtaattcattttggaaagcaacccactcctgctctgctccagctcgttagtagttc

SEQ ID NO: 83019 - DNA, 201 bp, Homo sapiens
tcacttacaccctgactgaacagctcgagggcttggctgagccacttgttcatctctagggatccttgtccatcagcccctttcccagggacatgttgcaycctggaggctgctgtgaggtgctggcacctctcctgaaggaaggccacctgatatcctagccagtgacagaggcctgcaccaactctgataccacagtgc

SEQ ID NO: 83020 - DNA, 201 bp, Homo sapiens
gttgttgtttttgagagaatttatttccatacgagttgtgtacttaacattagttttaaactacataaactaaaaataatgaaagtaacatctgcttatcrtaggaaagttggaaaatacagaaaagtcccatgcaggaaaacatcgcctgtgatcttcacctctgagatcaccattttaactatatgtactcttccaggg

SEQ ID NO: 83021 - DNA, 201 bp, Homo sapiens
ggagccctgaggtggaagaaagcctgggacattcaaggcttcgatagatctacacaggtacagagattggggtgtcgcctcccatccaagcacacagtacycaaacaccttagatgggttctcatcaagcttctccgaggtttgctctggcacctcagactcccctctgagcctcctgggccagcatctcctccacggccc

SEQ ID NO: 83022 - DNA, 201 bp, Homo sapiens
tgtggtccctgtcctcgctcaaaggcaattaccgtaaagtttcttgtgatacatttcaaaaacatttacagtgtataaaagaatatatgtgtatgtacatrtctatgtatgcttgtatatgtgactgtttacttatgaacataaatagtaacataaacaaaaataatcacaccatctaaaacaatcaggttgtctcaaagg

SEQ ID NO: 83023 - DNA, 201 bp, Homo sapiens
tacgagttgtgtacttaacattagttttaaactacataaactaaaaataatgaaagtaacatctgcttatcgtaggaaagttggaaaatacagaaaagtcycatgcaggaaaacatcgcctgtgatcttcacctctgagatcaccattttaactatatgtactcttccagggcctcctccacttgtctacagagctgatct

SEQ ID NO: 83024 - DNA, 201 bp, Homo sapiens
ttcttaatctcgatagcgtttggtcctcactgttggttcagagacaggttttaagtcaagataataatactcagcttgagtaaccactgcatgatcagacrgttcaaggttaattgtttaaaatttgtattaatcagtcaaaaattggtaatgtatgaacataggaagcttccaaaactacatgaggatatactatctcga

SEQ ID NO: 83025 - DNA, 201 bp, Homo sapiens
ctgaccagattgcagctggaatgttgcatccacctttggtcactacccattaagcaagaccctagtggtgccctgggaatgaagagcaggatatcatagcrtgtgaggagaagctggaccctggttagtataagaagatgtgatacggaggaaacttgagttctgtctttatgttttaaggatggagaaactcaaagcttt

SEQ ID NO: 83026 - DNA, 201 bp, Homo sapiens
attgctgctctagggtctgggaacatgcaactcatgcagggctcagggagaggagatggcatgtggggtgagagacaggtgcctcccaggctcagggagartgcagaatttatcctacatttgatgggaggccactggaggcttcattgacctttgaaaatgatcagtctgcctgttgtgtaaagagaaatggaggaagtg

SEQ ID NO: 83027 - DNA, 201 bp, Homo sapiens
cagagcagtaagcaaaagagaaaaagcccattctctgatcagctaatgttggcagtgagcgaacagtgagacctgtcctaaggttgcattaatagaagtayagtgggtagaataagggaggtggaggcctctgccctgaccagattgcagctggaatgttgcatccacctttggtcactacccattaagcaagaccctagt

SEQ ID NO: 83028 - DNA, 201 bp, Homo sapiens
atgaagggcggggcatttgtgggttaatacaaaaagcactccattcaatatgtaacccatagggaagagttaaccatttctcatttgcattagtattatcwgtgttgatttttttagcaccggtattaccctggagctctgagtcttttctcacatggctgccccaccccaggccctgccagatgaatctgccccatcctt

SEQ ID NO: 83029 - DNA, 201 bp, Homo sapiens
acaaatgctatcagcatagcccatctgcatgtcctgctactgaggaaagtgctctgagaggtcatcattggggaaggaactgagggagaaagaaaatgggrttgctttctggccctagtcatgcagggagtggatctctgtggagtttctttctctctgtaatggccagtagctgccctgccctctcccgagtgtagaatg

SEQ ID NO: 83030 - DNA, 201 bp, Homo sapiens
ccccaggatagaccagacttccatgtctggtgtccaaggtaatacacagattcatcaccctccgcaggaactatcctgctggctcttgcttgcacgggctycttgctttcttggtgtggctcttagagtcagcagacatgggttcaaagtcagatgtagctactgtgagctggcaggatccaagcaagcagcttcatgtct

SEQ ID NO: 83031 - DNA, 201 bp, Homo sapiens
tctcccgatacaggtccactctctgtgtgccggggcaggggagggagtgatgctgcaggaaggtcccttcacctccaagtccccactcctcagtggacagrcctttgtaggatcaagcttcggtggtcaggctctgtcttgctttggaagaaggaggtctggctggctgtcgcttcatattaacctggatgacgtgacatg

SEQ ID NO: 83032 - DNA, 201 bp, Homo sapiens
agcttctctgtgtttagagtaaatcctgccctcagtgagctgcaaaccttcagcctcatgcctcaccctgggctctcttctggtgccctgggaaggtgctsccaagtacctgtggagcctgttactctttctccaataaaaactgctaataaatactgccacgtctcgagcactggctgtggactggcacttgctcaatgc

SEQ ID NO: 83033 - DNA, 201 bp, Homo sapiens
actcctcagtggacaggcctttgtaggatcaagcttcggtggtcaggctctgtcttgctttggaagaaggaggtctggctggctgtcgcttcatattaacstggatgacgtgacatgaatatgcccagtgggacaagagcaggcccagcagaggccccttcctcctgaccatacccttcaccattcttgtcaaccttgggg

SEQ ID NO: 83034 - DNA, 201 bp, Homo sapiens
ctctgggcatctccggagcagtggggctatgaatgacctctgcgctgacccatgtccttgcctctctccatagactcgcctgcaggctggcgttggctacrgaaacaccctcagctgcatccgcgtggtgtacaggagggagagtgtaagtgccccttgggcgggtggagtgatgcctgcctgggcccccacaggctgggg

SEQ ID NO: 83035 - DNA, 201 bp, Homo sapiens
ggttttcactgcagatgttcggcttcttcaagggcatgtccttccccctcgccagcattgccgtctacaactccgtggtgtttggggtcttcagtaacacrcagcggttcctcagccagcaccgctgcggggagccagaggccagtcctccccgcacgctgtcagacctgctcctggccagcatggtggccggcgtggtct

SEQ ID NO: 83036 - DNA, 201 bp, Homo sapiens
attcatggaagagctggagttggctctaagtttcaaaataaaagcattaaaaacctcttcacattgtttctctgtcagatgcctctgcctagcttccaagrggcacctggccactgtcattcctctctctctgttcaggcctctgtgggtgttgcaggcccagagggaaaacccctccacacaggtgaggagagaaactga

SEQ ID NO: 83037 - DNA, 201 bp, Homo sapiens
tttccccatttcacagatgagaaaactcaggtccagaaatgttaagtagccaatcccaggtcatacagctggagctgacagtatagcagggactctgcagycagaaagatttaagttcaaatccacacttcatcattttgtgaccatggacttgttgcttaacctccctgctcagaatcctgcaccacatccttctttcat

SEQ ID NO: 83038 - DNA, 201 bp, Homo sapiens
gcgacggcagccccgggtcctcacgcctcttccttctggttttcactgcagatgttcggcttcttcaagggcatgtccttccccctcgccagcattgccgyctacaactccgtggtgtttggggtcttcagtaacacgcagcggttcctcagccagcaccgctgcggggagccagaggccagtcctccccgcacgctgtca

SEQ ID NO: 83039 - DNA, 201 bp, Homo sapiens
ccctaattgtgtgccaaacacaatgctaggagcttggcatatgtttaatcttcacaacaacccaattcctggggatttactatggggagactgaggaacaragaggtttcatacccccaggtccctcccttagtgggaggtggaggaggtctgattcagaggcactgatgctttctctgcttttgccccaggatttgtaga

SEQ ID NO: 83040 - DNA, 201 bp, Homo sapiens
aacaactgcttatatatttaccaacaattactggaaattcaaacagaatttcaaaaatatttatccatttaggtataataataaacccatgacattttaamataaataacattctatgaaaataacgattctttctaaaccaatataattaacgagaagacttgcgttttccgtttttgcggcgaagtctggcttaaacag

SEQ ID NO: 83041 - DNA, 201 bp, Homo sapiens
catctaggaatgtaccaatttctgtgtttctataataacctggcattgttttcctagagttccttacctgagcatatcccatgaggatgacctagtggcaygtgatcccaaggcttctattccacatacttgaaaaagaaaagagatttttcaaaaagctgtccctgctctctttttgcaacccccaggctggcccttcct

SEQ ID NO: 83042 - DNA, 201 bp, Homo sapiens
ttcctcaaatcaatctcataggaggcttataagttagggctttttcaaaggcagtttgtgggaagggatggagatggctaggcaatgggtgcttgctgctsattggttggcatgcaatcatagaggtgtggaaaattgtcctcctatgcacattgttgcttctgggtgaggccacaggagcagggtttgtgggtccaggag

SEQ ID NO: 83043 - DNA, 201 bp, Homo sapiens
tgtgaagcccctgctacagggattgggcatggctgggtgctctgtctactcagggcttctagattcccgaggagagagagagagagagagagagagagagwgtgtgtgtgtgtgtgtgtgtgtgtgtgtgtacatgtgagagaagaagaaagagagggagagagagggcaatttaaaaagcatatgtaggtgtttgcctgg

SEQ ID NO: 83044 - DNA, 201 bp, Homo sapiens
tcacctcctatgggatccactgtggaagaagttggctccatctcctgtccacactgaagttggcctaatggatatggcaggggtttactcccttccccackggaagatggaaaatacagcatgggtttgttcaagcatacttcccaggcatgcagaaaccaccccctcaacctcacctgcttctgggatgagttaaagtac

SEQ ID NO: 83045 - DNA, 201 bp, Homo sapiens
gctcctctcctccataccttagcagaattcaggctcctctcctccctctagcctgttgacctctcattacttttagggaagggcgattatcatttaaagtrtaaactaaatgtctggcaaagttagctcagcctaagccaagaaataatcaaggcagcttgaaggataaagtcaaaagggggattggctagattaggttgc

SEQ ID NO: 83046 - DNA, 201 bp, Homo sapiens
agttctagagagtttgccattggcccaagtgactcaatggcaaagccgtgcctcaaccccatgtctgcagagtcttaagcacagctcgagttctgttctcygccacttttgggatgtcctgtgaagcccctgctacagggattgggcatggctgggtgctctgtctactcagggcttctagattcccgaggagagagagag

SEQ ID NO: 83047 - DNA, 201 bp, Homo sapiens
tctgatcttgctcagaggggtcttgtgcccccaaaggtggctactaccccggctcacctcctatgggatccactgtggaagaagttggctccatctcctgyccacactgaagttggcctaatggatatggcaggggtttactcccttccccactggaagatggaaaatacagcatgggtttgttcaagcatacttcccagg

SEQ ID NO: 83048 - DNA, 201 bp, Homo sapiens
atactagggggcacagcctcaggcatgggctgtggggacctttttctaagagcgccttgttaatatggaaaatgtggtccaacccatcgaacagcagctgyacttttaagagttcgtggactaagaaaacaaatatgtaaggaagctactatggattactaatatgtttaagtaaaatcttattgtgttacctgtgatagt

SEQ ID NO: 83049 - DNA, 201 bp, Homo sapiens
atatttctcaaccctgcaaagctttgagccattagaacctgggctcatcggcttagcacaaagagcaaagccaaagccaaagatggttcaccaagtgcatrgagggagagtaaaagccaagattggaggacccacctctgccgtgcccccacaagtttctgtgatctggactgaataagaatggtcttggcagtagtggct

SEQ ID NO: 83050 - DNA, 201 bp, Homo sapiens
ccttaaacctcatgaaccaaccactgccagcttcaaacttttcttctgcagcttcctcacctctctccaccttcagagaattgaggagagttatgtccttkctctgagttaggctttggcttaagggaaagttgtggctcatttgatgttctatccagactactcaaactttcttcataccagcaataaggatatttcact

SEQ ID NO: 83051 - DNA, 201 bp, Homo sapiens
ctgctctagggtctgggaacatgcaactcatgcagggctcagggagaggagatggcatgtggggtgagagacaggtgcctcccaggctcagggagaatgcrgaatttatcctacatttgatgggaggccactggaggcttcattgacctttgaaaatgatcagtctgcctgttgtgtaaagagaaatggaggaagtgaggg

SEQ ID NO: 83052 - DNA, 201 bp, Homo sapiens
caggagaccagggagggcttcaggccatgtttctggtgaggatgaggggtgaggcctagggtggtggttctagggacaagaagagcaggtgtcccccaaakatattttggagggtggagcgacagacagcagatagggtagagtcccagtttaggtttttgtactcaagaggtggggatcgtacaatcattcggcacaact

SEQ ID NO: 83053 - DNA, 201 bp, Homo sapiens
ctttgctgtcattttaacaacattcacagaatcttcaccactagtagatttcatctgaagaaaaactgtctttctcatccataagaagtaactcttcatcmgttaaatattatcatgagattgcaccattcagccccatcttcagcctctacttctcattctagttctcttgctttctccatcacatctacagttccttcc

SEQ ID NO: 83054 - DNA, 201 bp, Homo sapiens
aaattttgaatgaaatgacctgatttaaagaaaccatcaggtggaaccctgtcgcagccctctgacttttccctgagtcactggaaatgtggtcccactgwagccattgtctccaccggactccatcctaacaagtgtcctggggctcggaagcctcctgcaggcacctagagttttcccacggatgaagtgtgtcttgcg

SEQ ID NO: 83055 - DNA, 201 bp, Homo sapiens
gagaaatggaggaagtgagggagaagcaggagaccagggagggcttcaggccatgtttctggtgaggatgaggggtgaggcctagggtggtggttctaggracaagaagagcaggtgtcccccaaatatattttggagggtggagcgacagacagcagatagggtagagtcccagtttaggtttttgtactcaagaggtgg

SEQ ID NO: 83056 - DNA, 201 bp, Homo sapiens
tggggcagcggagcttctgccttggagggattcaactgaccattggtcaactgatcaccaactattccagctttggacctgcacctggtaacaaacaaacraacagaacaaaacaaaactggagtaaaatagaccctccccccatggccattgtaaactcactgtgaattcatggaagagctggagttggctctaagtttc

SEQ ID NO: 83057 - DNA, 201 bp, Homo sapiens; identical to SEQ ID NO: 63668

SEQ ID NO: 83058 - DNA, 201 bp, Homo sapiens; identical to SEQ ID NO: 63669

SEQ ID NO: 83059 - DNA, 201 bp, Homo sapiens; identical to SEQ ID NO: 63689

SEQ ID NO: 83060 - DNA, 201 bp, Homo sapiens
cagtaacagtaccctagaaagtgcaccaaatggaaaagactatgaaagtacagagattgtagctgaagaaactaagccaaaagatactgaattgagccaaraatcagattttaaagaaaatgggatcactgaagagaaatccaaatcagaagaaagcaaaagaatggagccaattgctattattattacagacactgaaat

SEQ ID NO: 83061 - DNA, 201 bp, Homo sapiens
ttacaagccatagagaaactgggcatttctatactagagaaaccacctaaaacaactgtatggagtaagatgaaaggtatgaatatgcctggaagaaattktacctagtgtgacatttttgctcatctttttgtcacaaaaggctgctaaggaagagagaatacagttttctagagaataagagtgcagtgtaaaaatgga

SEQ ID NO: 83062 - DNA, 201 bp, Homo sapiens; identical to SEQ ID NO: 63672

SEQ ID NO: 83063 - DNA, 201 bp, Homo sapiens
atctttccttgtgtgaaatggccataataccagagtgcacttccctacctcacaggttaggattcaaagtgtgtattcccccattgtgtaaattgagtgaytgtgttactacttgaaacagatgaagtaataaagatgaagtatgagatgtaaggtatttgttcaagagctccacttggaggaaataatgcacattagatg

SEQ ID NO: 83064 - DNA, 201 bp, Homo sapiens; identical to SEQ ID NO: 63678

SEQ ID NO: 83065 - DNA, 201 bp, Homo sapiens
tttataaaactctaccactgaaatgcagtcacttctggattggaggaagtcagcacagattgcagtgtaaaatgacataacatacagggagttgctaaaayggcatatggagattggagtgctttgggggaggaaggtgtatttattgagcacttatggtatgccataagctttttaatgacctctgatataacaaagtct

SEQ ID NO: 83066 - DNA, 201 bp, Homo sapiens
gaaagatggtgatgaggtctgtgaatcaaatgtgagcaatagcataacttctggagagaaagtgatttcagtagaacttggattagataatgggcattctsctattcaaacgggaactctaatccttgaagaaattgaaacgatcaaggaaaaacaagatgttcaaccccagcaagcaagcccacttgaaacttcagaaac

SEQ ID NO: 83067 - DNA, 201 bp, Homo sapiens
actttgggaggccaaggcgggtggatcagctaaggtcaggagttcgagaccagcctggccaatgtggtgaaaccccatctctactgaaaatacaaaaattrgctgggcgtggtggtgcacgcctgtaatcccagctacttgggaggctgaggcaggagaattgcttgaacccgagaggtggaggttgcagggagccaagat

SEQ ID NO: 83068 - DNA, 201 bp, Homo sapiens; identical to SEQ ID NO: 63732

SEQ ID NO: 83069 - DNA, 201 bp, Homo sapiens
ggtggatcagctaaggtcaggagttcgagaccagcctggccaatgtggtgaaaccccatctctactgaaaatacaaaaattagctgggcgtggtggtgcaygcctgtaatcccagctacttgggaggctgaggcaggagaattgcttgaacccgagaggtggaggttgcagggagccaagattgcaccactgcactccagt

SEQ ID NO: 83070 - DNA, 201 bp, Homo sapiens
gagccaagattgcaccactgcactccagtctgggcaacagagcgagactccttctcaaaaaaaaaaaaaaaaaaaaagagaaccattcacaaatccttcartcaggcaaattgttactaagtgcaaaagtgtagaaacagggagagtgggtttttcccccgcttttctttctgcctcaacagatctgtatatatccatttc

SEQ ID NO: 83071 - DNA, 201 bp, Homo sapiens
caggaagaagctgaaattttggatatacaaacacagaccccattgaatgatcaggcaacaaaggctaagtcaacccaggatctaagtgaaggcatctcacrgaaagatggtgatgaggtctgtgaatcaaatgtgagcaatagcataacttctggagagaaagtgatttcagtagaacttggattagataatgggcattct

SEQ ID NO: 83072 - DNA, 201 bp, Homo sapiens
tctagtgctcactgaaacattgtgaggagaaacactgtcaaatgttcatattttagttccgtcattgttctagaatgactttatctttctgttagaggcayacagtatgaaacacccaacctaagataatatttacttagatcataaactgattttcagggttccagttccttctacagttcataaaattatgggttaccc

SEQ ID NO: 83073 - DNA, 201 bp, Homo sapiens
ttttcccaatttcagcagatagtgtgcagaatatgcatattgatattaaacgtgagtggtttcctagtcttaagtctcttataagcgctatttggccaggsgcagtggctcacgcctataatcccagcactttgggaggccaaggcgggtggatcagctaaggtcaggagttcgagaccagcctggccaatgtggtgaaac

SEQ ID NO: 83074 - DNA, 201 bp, Homo sapiens
aatgatcaggcaacaaaggctaagtcaacccaggatctaagtgaaggcatctcacggaaagatggtgatgaggtctgtgaatcaaatgtgagcaatagcayaacttctggagagaaagtgatttcagtagaacttggattagataatgggcattctgctattcaaacgggaactctaatccttgaagaaattgaaacgatc

SEQ ID NO: 83075 - DNA, 201 bp, Homo sapiens; identical to SEQ ID NO: 63711

SEQ ID NO: 83076 - DNA, 201 bp, Homo sapiens
ctgaagctgctgatgtggcaaggaagtgtccacaagaagcaggagcttctgatcagccagagcccacacggggggcctgggcctcactcaaacgtcttgtmacacgcaggaaaaggtcagagtcttcaaagcagcaaaagccattggagggtgaaatgcaacctgcaataaatgctgaggatgctgatctttctaagaaaa

SEQ ID NO: 83077 - DNA, 201 bp, Homo sapiens
ggagcttctgatcagccagagcccacacggggggcctgggcctcactcaaacgtcttgtaacacgcaggaaaaggtcagagtcttcaaagcagcaaaagcyattggagggtgaaatgcaacctgcaataaatgctgaggatgctgatctttctaagaaaaaggcaaaatctagacttaagattccctgcataaaattccca

SEQ ID NO: 83078 - DNA, 201 bp, Homo sapiens
caggcaacaaaggctaagtcaacccaggatctaagtgaaggcatctcacggaaagatggtgatgaggtctgtgaatcaaatgtgagcaatagcataacttytggagagaaagtgatttcagtagaacttggattagataatgggcattctgctattcaaacgggaactctaatccttgaagaaattgaaacgatcaaggaa

SEQ ID NO: 83079 - DNA, 201 bp, Homo sapiens; identical to SEQ ID NO: 63667

SEQ ID NO: 83080 - DNA, 201 bp, Homo sapiens
aacccgagaggtggaggttgcagggagccaagattgcaccactgcactccagtctgggcaacagagcgagactccttctcaaaaaaaaaaaaaaaaaaaargagaaccattcacaaatccttcaatcaggcaaattgttactaagtgcaaaagtgtagaaacagggagagtgggtttttcccccgcttttctttctgcctc

SEQ ID NO: 83081 - DNA, 201 bp, Homo sapiens
ctcttgatatactcattattttctgcattaacctatgaattgttcatctttatgatttttcaaaagactaatcaatgtgaaaatgctagaattattcagayggtacatactaaaggtgggtgtttaaaaagttctgtgtttactaagacactgatttcattttggtaatgttaacactctatcttttcgtaaccacagccc

SEQ ID NO: 83082 - DNA, 201 bp, Homo sapiens
atgaagtatgagatgtaaggtatttgttcaagagctccacttggaggaaataatgcacattagatgattttaaatgatctgggtgaattcttgcattgtgyatggattgcatatagaaagtatttgctactttgtcctacagaatcatcttcatttctttctgtaaatacatattgagacctctaacaaaagaaactaatc

SEQ ID NO: 83083 - DNA, 201 bp, Homo sapiens
atttagagttctttaggttcaaattcctatgatgttttattgggtaacatgaactctcttatacataattcaaaatttcaatccatggtatattttatggkacattttgaaaagaaaatttgtaatgctccttagttacaaaaattagaaggaagctacataaaattcaggtgtcctaattaaattcaatttgattcaaca

SEQ ID NO: 83084 - DNA, 201 bp, Homo sapiens
acccaagaaattatttcacactctacaattacattgatatttaagagacaataaaaactttctttactttctagattgtataactctggattagttcaaaytaagtaagatagaacaactttatactagtctctataaataaacaattccgtaagagtgttcaaagtatggaaattatgttgactacattaaatgaacaaa

SEQ ID NO: 83085 - DNA, 201 bp, Homo sapiens
ttttacggccaaggcacctcctccccagctagacagcctggctccttcacattcccctcaggagatagggtggaagctcacagctccactttgtaaggcayagagggcagctgaaagtcctgcttggcctctctgggcaaccacaggcgccaataaatcagccacaggcgattctctcattcccttcccggctgaaacagg

SEQ ID NO: 83086 - DNA, 201 bp, Homo sapiens
cagcctcccgagtagctgggattacaggcgcccgctatcacgactggctaactttttttatttttagtagagacaggttttcaccgtgttggccaggctgktctcgaactcctgacctcagcctcacccttccaaagtgctgggattacaggcatgagccaccgcgctcagccttacttttttcttttaacaattaaaaaa

SEQ ID NO: 83087 - DNA, 201 bp, Homo sapiens
ccattcatctattttgatcagttagttcctcaactttccttactactcccatctcctttgtaacatatacttctcagtaataaatggccagtgctctccaracatcctagcatcaacaacttctgggattgcagggtaccaaaaagctctgggggaacatacccttgtagaatccctcccacatccttgataacctgaggt

SEQ ID NO: 83088 - DNA, 201 bp, Homo sapiens
cacaatcaggagagctcatttttagatgatagaaacattaattctaagcatccagattatgaaccatcttttttttcaaatgcttatgtttaaaaaatttwaaaaaaattaaggatcttattatgagggaaaagcactgttgccaaaaatataattttactcagaatcactagggcagattaggaggcttataagcctagg

SEQ ID NO: 83089 - DNA, 201 bp, Homo sapiens
agttacattcgggaaataattaaatttaaattctaggggctatgcttgtgtttctattctctgttctgttaacagtgtgttggcctagtgccaaagccaakaaattctgatctaagaattatgttgtatcttgtagagcagtcaacttgtaatattatttttcttgagttttgtctttttctgtgtggcagtggtgaaata

SEQ ID NO: 83090 - DNA, 201 bp, Homo sapiens
tatctactccaaaagaacgtgtgtcaagacgctttgggcggagttttacctgtgatagctgtggatttggctttagctgtgaaaaattattagatgagcaygtgctaacctgtactaacagacatttataccaaaacacaagatcttaccatagaatagtagatattagagatggaaaagacagtaacatcaaagctgaat

SEQ ID NO: 83091 - DNA, 201 bp, Homo sapiens
ggataacttgaatattcattctaataattagactaagtgaaaatctgagaaagagttaattgcaatgtgatagtgggtagaaaggagagaaaaacccactraagggttcaaatacatgtgaattctactgctttaagagaaataaaacaaataagcctagggaaatattagagtctaaaaaaccctagagttaatctcttt

SEQ ID NO: 83092 - DNA, 201 bp, Homo sapiens
cggaggttgcagtgagccgaaattgccccattgcactccagcctggatgacagagccagaccctgtctcaaaaaaaagaaaagaaaaaagaagtcccaaasagagtgagctagacattgaaaaggttctaagcaaaggaacagcatgtgtgaaatggcaaggcttttggtgtgttaggttatttgggatcgggggaatctt

SEQ ID NO: 83093 - DNA, 201 bp, Homo sapiens
aattagactaagtgaaaatctgagaaagagttaattgcaatgtgatagtgggtagaaaggagagaaaaacccactgaagggttcaaatacatgtgaattcwactgctttaagagaaataaaacaaataagcctagggaaatattagagtctaaaaaaccctagagttaatctcttttgggaacataaggaggtatacagaa

SEQ ID NO: 83094 - DNA, 201 bp, Homo sapiens
tttggcagcattaataaagaggtcaaaaaaatgaaaaaagagcaaactcctcttggaatttgagtgaaattataatttaatgaaagtgaatgcctcataattttttttttttttttttgagatggagtcttgctctgtcgcccaggctggagtgcagtggcacagtcttggctcactgtaagctccgcctcccgagttccc

SEQ ID NO: 83095 - DNA, 201 bp, Homo sapiens
aacactttatacagtgcctggtataccaaaggtagtcagtaaatgtttgttgaatgaataaatgtgcattaaaatgctataagtgctcttatttaaatgtyttagtgttttatgttaataaaagaatatgtatttttactcagttgaattgtgactatagctatagatgtgcctatcatattgatcttctatgtagttgta

SEQ ID NO: 83096 - DNA, 201 bp, Homo sapiens
tttgtgtatttttttcatcttttttccccccaccttttgaataaggttgtggcgtggatttgttttatataattctaacataattatgtatcctgtgtttrtttatttggctctccatcttgaacatttttcccacttctgtagttgccatttagaaatatatatatatatatatatatatattttttttttttttttttt

SEQ ID NO: 83097 - DNA, 201 bp, Homo sapiens
ttaggtattaaatgtttatcatttttgttgtttcttaatagaattatttgtttttagtttttcttagctatgattaaaatttttaaatgtagactacaagyggttgttacccattcaatgactattaaactttagtttttcatcaataaggtgatgacttcactatttctatgtgtttttttttttttaaggttatcctgt

SEQ ID NO: 83098 - DNA, 201 bp, Homo sapiens
atttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactca

SEQ ID NO: 83099 - DNA, 201 bp, Homo sapiens
agaaatgacgcacatgggttaaatggtatatggcaaactaacagtttgagtatggacaaaaattcaattagaagaaaggatcccagaggggctaataattwaaaaaaaaaaaaagtttgctagagcagtcaggacactaattaaaaggaaaagtagaggctgggcaccagcaccttgggaggccaaggtgggtggatcacc

SEQ ID NO: 83100 - DNA, 201 bp, Homo sapiens
tttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcac

SEQ ID NO: 83101 - DNA, 201 bp, Homo sapiens
attaccttatttctatactactatgttaaacctactactttaatgatctggctaccgtctgccaaatgtcacttttcaagtgagaacagaagaatgagatwgtgaagattctgtggacaatgtctatataatcatttaagtgttaaatataaactaaatgacaatagcagcttgtaaattaatgctaattctggctgggag

SEQ ID NO: 83102 - DNA, 201 bp, Homo sapiens
ctggagtttgaacctaggtttctgacttctacattcctgtactccacctatcaagaagtacaaagaagggccttttcagcctagaaacacatgtgataaarctcctatgagattgtgctccttgttcatctgtcatctgctgtgctggtaaggtggctagtaatagtgggtacccaattaacatgctgaataatgtgaaaa

SEQ ID NO: 83103 - DNA, 201 bp, Homo sapiens
ttgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcact

SEQ ID NO: 83104 - DNA, 201 bp, Homo sapiens
gctgtggtcagagaattgcttgagcctgagaggtcaaggctgcagtgagccgtggttgtgtcactgcactccagcctgggcaacagagcgagaccctgtckcaaaaaataaaaacaaataaattcatcatatctttgactaataaacagaagaacccccttccccagttaccataggtgattgatttgattaagatttata

SEQ ID NO: 83105 - DNA, 201 bp, Homo sapiens
tgttttatataattctaacataattatgtatcctgtgtttatttatttggctctccatcttgaacatttttcccacttctgtagttgccatttagaaatatatatatatatatatatatatatttttttttttttttttttttgagacagtcttgctctgtcagccaggctggagtacagtggcatgatctcgactcactg

SEQ ID NO: 83106 - DNA, 201 bp, Homo sapiens
ataattttactcagaatcactagggcagattaggaggcttataagcctaggaatttgcaggaaaacccctcctcttcttttgtgcgtgtatgtgtgtgtgygtgtatgcttcattttcatttgcagagtggctgaagacagtaaaaagaatatgaactttaaaaaaattgttagatttatgtttcaatcagagatttgtca

SEQ ID NO: 83107 - DNA, 201 bp, Homo sapiens
aattatgtatcctgtgtttatttatttggctctccatcttgaacatttttcccacttctgtagttgccatttagaaatatatatatatatatatatatatwtttttttttttttttttttttgagacagtcttgctctgtcagccaggctggagtacagtggcatgatctcgactcactgcaacctccctcagccaggctg

SEQ ID NO: 83108 - DNA, 201 bp, Homo sapiens
gatagattaataagaacatcttatatttgaatggtacgagttacattcgggaaataattaaatttaaattctaggggctatgcttgtgtttctattctctrttctgttaacagtgtgttggcctagtgccaaagccaagaaattctgatctaagaattatgttgtatcttgtagagcagtcaacttgtaatattatttttc

SEQ ID NO: 83109 - DNA, 201 bp, Homo sapiens
ttatgtatcctgtgtttatttatttggctctccatcttgaacatttttcccacttctgtagttgccatttagaaatatatatatatatatatatatatatwtttttttttttttttttttgagacagtcttgctctgtcagccaggctggagtacagtggcatgatctcgactcactgcaacctccctcagccaggctgga

SEQ ID NO: 83110 - DNA, 201 bp, Homo sapiens
acccactgaagggttcaaatacatgtgaattctactgctttaagagaaataaaacaaataagcctagggaaatattagagtctaaaaaaccctagagttamtctcttttgggaacataaggaggtatacagaactgcagacctctaaacataagtaggaaaaagaaaaataaaagaatattaccaataattaaaggtgcca

SEQ ID NO: 83111 - DNA, 201 bp, Homo sapiens
atctcaccttgaattgtagctcccataattcccatgtgttgtggtgaaagataattgaatcatgggggcggtttctcccatactattctcgtggtagtaasagctgatggttttataaggggaaaccccttttgcttggttctcattctctcttgcctgctgccatgtaactggtggtagtgagtaagatctgattttttt

SEQ ID NO: 83112 - DNA, 201 bp, Homo sapiens
gtggtggtcagattgcaagatgtgtttgtaatatctgggcacagaggtagcacagttattgtgcaaaagaaactattcctctgaagctctaattttagtgwttctatgtgagaactctggcctgcttgctcttttgcaatcttggtttgcttgaggtgtgttgagggctgactgaatgcaagagatttaaagaatttgtgt

SEQ ID NO: 83113 - DNA, 201 bp, Homo sapiens
agaggcatctgcctcaccctaagatcagaaaaaacttcccaaagaggccaggcacaatgtctctcacctgtaatcccagcaccttgggaggcctaggcagrcggattgtttgatctcaggagtttgagaccagcctggccaacatggcgaaaccctgtctctacaaacaatacaaaagttagctgggcgtggtgccgcatg

SEQ ID NO: 83114 - DNA, 201 bp, Homo sapiens
aaaacatccatgcatgactgatttgtaaccagagaagaaatgaattagaaaaatataaaaaataactgaacactctaagcactttttctcccaataaagcraaaaaaaaaaaaaaaaaaaaaagagagagagagagagaaagaaaattcctgctagcaaagggaaagcagaacggtaaataaatgcctataatcccagcac

SEQ ID NO: 83115 - DNA, 201 bp, Homo sapiens
aaacatccatgcatgactgatttgtaaccagagaagaaatgaattagaaaaatataaaaaataactgaacactctaagcactttttctcccaataaagcamaaaaaaaaaaaaaaaaaaaaagagagagagagagagaaagaaaattcctgctagcaaagggaaagcagaacggtaaataaatgcctataatcccagcact

SEQ ID NO: 83116 - DNA, 201 bp, Homo sapiens
gcaagagcaggaaaggtagggatggagtagatgggcagatttgagaaatatttaatgggaaaattggcaacacttaatggttgattatgagggagaagttmtaggtagctcccaagtagtctaggtgattggtacatagtggtggcagctgagacaaaatacagggaggggcatttttaagtgggttccagacaaaatctg

SEQ ID NO: 83117 - DNA, 201 bp, Homo sapiens
gctctggttcctgttgcggccggtaagtatttgccagttgtggggctatttgcgcaactttggcccaggccggagggcgacgggccgcgggcctggcggastgcggggccggaggggcgccgatccgtgcggggagccggagcgcggcggacgcgctgcgaggacccggtgacgggcggctgccaggccgcctgcttgttg

SEQ ID NO: 83118 - DNA, 201 bp, Homo sapiens
ctgggattacaggcgtgagccacggtgcccggcctcaaaaatttttaatgaaaaaattatcttcaagagataagctaaaagtctcacaggaatttagatcyctcctcccctgccgcatactcctctacctgtttttggtgtagtaatccttcttaaagcttttctgggctaggcacagtggtttatacctgtaatctcagc

SEQ ID NO: 83119 - DNA, 201 bp, Homo sapiens
ctttcattactcatatccttcaagagttgttttctttttttttttttcttttgagacagagtcttgctctgtcatccagactggagtgcagtggcgtgacrcaactcactacagcctctacctgtcgggctcaagtgatccacccactttagcctcccaagtaactgggactacaggtgatgccaccacacctggttaatt

SEQ ID NO: 83120 - DNA, 201 bp, Homo sapiens
gcggctcggcggcgggtgggaggggaagtgtcccggagcccgaggctgcagacttgggcgcgctccgagggaggaggcgtaagatccgtgcaaattcttgytacgctgtttcccaccccctctcgccggcacacacgctttttgttcagtaaaaagtggaaggtctgagtttgggaattttaagtggaaaagatctgtttc

SEQ ID NO: 83121 - DNA, 201 bp, Homo sapiens
acattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccg

SEQ ID NO: 83122 - DNA, 201 bp, Homo sapiens
cattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgc

SEQ ID NO: 83123 - DNA, 201 bp, Homo sapiens
attctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgcc

SEQ ID NO: 83124 - DNA, 201 bp, Homo sapiens
gatctaggaaaagtaaaaattcctcaaatgaatacagaatacttgtgctactgctgatgatcaacactttatacagtgcctggtataccaaaggtagtcartaaatgtttgttgaatgaataaatgtgcattaaaatgctataagtgctcttatttaaatgttttagtgttttatgttaataaaagaatatgtatttttac

SEQ ID NO: 83125 - DNA, 201 bp, Homo sapiens
gtttgcttgaggtgtgttgagggctgactgaatgcaagagatttaaagaatttgtgtttctcacattctttgtttcagttgtagctgagactgtatctctmagtcatatatcatcagttctacaaagaatatgcattgcttccagcccactaattcccttttctaaaaaaacaaagaaaagaaaagaaagaaagaaagaaa

SEQ ID NO: 83126 - DNA, 201 bp, Homo sapiens
tgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctgaacactaatagcattgctcttt

SEQ ID NO: 83127 - DNA, 201 bp, Homo sapiens
attcaagaaaagacaaaggcactgatcaaacttgtttggtgccatttctatataatctaataaggttgttgttgttgttgttgttgttgttgttttgaaayggagtctcgctctgtcgcccaggctggagtgcagtggtgcgatctcggctcactgcaagctccgcctcccaggttcatgccagtctcccgcctcagcctc

SEQ ID NO: 83128 - DNA, 201 bp, Homo sapiens
tcccctttttcaaaattttttcaaattcatggaaaagaggataggaattatggttaaaattagtactaactgatgacattaaccgattaataaccaattaygttcttaaaaactggaaatgatatacaccactagataaaataatcttaaatgttcattgactttatagaattctctcaacattactttttggtcacagat

SEQ ID NO: 83129 - DNA, 201 bp, Homo sapiens
tggtttcgatctcctgacctcgtgatccgcccgcctcggcctcccaaagtgctgggattacaggtgtgagccaccacacccagccctaataaggttttttwaaatttttatttttgggatagagtctcactctgtcacacaagctagagtacagtggcgtgatcatggctcaccacaacctcaaaatcctgggctcaagcc

SEQ ID NO: 83130 - DNA, 201 bp, Homo sapiens
agcctattgcttgcctgtatccctcccttctagtgacactaatcttctgtacagaaatcctagtccagcaaacattgctctcatcttcgcccatacacaayctatgtaaagaatggctttcctactctttgctggcgaacttcagctcccggattaggcatgccacctcttccaggtagctctcagcaacgcacttttcca

SEQ ID NO: 83131 - DNA, 201 bp, Homo sapiens
aaaatttttaaatgtagactacaagtggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactat

SEQ ID NO: 83132 - DNA, 201 bp, Homo sapiens
cctgtttcttcatttgcaaaatgaggataataaaaatacctatctcagggtggttgtgagatcagttgtataatgtatgggaaaatgctttaaattttaaytttaattttaatttccaaccactatataaaagttgccatgattgaaataaacaaaaaattgataagcaaaataaaacttacctgtttaaacatttattca

SEQ ID NO: 83133 - DNA, 201 bp, Homo sapiens
catataagaagatacaagtttcatatattttattcacttaattataccaagaacatttttccgtgtcattaaaaatcttgtaaaccatttttacggctgcrtaagaattcatcatatgcatgtactataatttaggtaatctcttatttttggatatttaaaccatttcctttctattatcattaacataaataatactac

SEQ ID NO: 83134 - DNA, 201 bp, Homo sapiens
agttatttggttggcaacctcagctatccagtgccttggcctgatgcaaaagaggaaggaaatatgatcgcctgtcagcaaaattcaggaattaaaacttwacatcttatgagcatttccctagatcttcagaagatgttgtgctccctctttaggatgaatggatatgtagattcaattttcaatgagtttttgtctaat

SEQ ID NO: 83135 - DNA, 201 bp, Homo sapiens
aagtataggacagcctcacttcttccagattatttcaatctattccacaagggtctataaggttagcactaaaagttgaagtaggtataatttgtctgctrttgtcatagattaacttctcttttggaaaaagccttccaggttcaggtctcttacccttccataccaggcatggaaatgtcttaccccagcctactgtgt

SEQ ID NO: 83136 - DNA, 201 bp, Homo sapiens
gcatatatccatatatatccatatgtgtatatgtgtaatgtatctgtgagagatatatatacatctccctatacatctgcctggaatagagcctggcatayagtgagacataacaaatgttagctattcatattattattgtattacagttgtcatttactctactttgataaccttcatctaccagtccagtaaagcaaa

SEQ ID NO: 83137 - DNA, 201 bp, Homo sapiens
ctacgattccttagtaaacaggactaagaatctcagaaattaatagagcacaaccaaggcagcagtagattaggactcagaaatgcgtcttcatctccccyatgtttttaaggtaaaaatattcagaggccaggtgtggtggtttgcatctgtagttccggctactcgggaggctgaggcaagaggattgcttgagtccag

SEQ ID NO: 83138 - DNA, 201 bp, Homo sapiens
ttataaaatccatgctctttgaaaaattcagcctgtattgaagtacataaaatacaaaaatgaaagtcattttgactcccactccccagagataatcaccrtgtacagttaattccttgtttaaaacgagagaaggcaacatttgatcacagctgtgtgtgcctcactctgcctggggatggcctgtggtgattcatggac

SEQ ID NO: 83139 - DNA, 201 bp, Homo sapiens
ccagggccggggtgtgcgtgcgtgcgtgcgtgcgtacgtgcgcgccctcccgcccgcccgcctcagtggccgggcgggggtcggcccgcgctctgagtgcygccgccacagttcgcagttgtgactctgtaggcggaagcatagggacaagcctgagcgtcacaggctccccacaaacaaccgcgtgacccggggactttc

SEQ ID NO: 83140 - DNA, 201 bp, Homo sapiens
tctactaaaaatacaaaaaaattagccaggcatgttggcacaagcctgtaatcccagctacttaggaggctgaggcaggagaattgcttgaacccaggagrtggaggttgcagtgagccaagatcacaccactgcgctccagcctgagtgacagagcgagactccatctcaaaaaaaaaaaattagccaggcgtggtggcg

SEQ ID NO: 83141 - DNA, 201 bp, Homo sapiens
cgcctcccgggttcgcgccattctcctgcctcagcctcccgagtagctgggactacaggcgcccaccaccacacccagctaatttttttgtatttttagtmgagacggggtttcactgtgttagccaggatggtctcgatttcctgacctcatgatccacccgcctcggcctcccaaagtgctgtgattacaggcgtgagc

SEQ ID NO: 83142 - DNA, 201 bp, Homo sapiens
gttcctgttgcggccggtaagtatttgccagttgtggggctatttgcgcaactttggcccaggccggagggcgacgggccgcgggcctggcggactgcggrgccggaggggcgccgatccgtgcggggagccggagcgcggcggacgcgctgcgaggacccggtgacgggcggctgccaggccgcctgcttgttgccggcg

SEQ ID NO: 83143 - DNA, 201 bp, Homo sapiens
atcgcttgaacccaggaggcagaggttgtggtgagctgagattgtgtcattgcactccagtctgggcaacaagagtgaaactccatctcaaaaaaaaaaaraaaaagaaaaaaaagaatcaaaagtgctcctaaactggcaggatgggcatgggtgggggggtggaggaacacactattttcagacttcttttcaaatagt

SEQ ID NO: 83144 - DNA, 201 bp, Homo sapiens
ccaggaggcagaggttgtggtgagctgagattgtgtcattgcactccagtctgggcaacaagagtgaaactccatctcaaaaaaaaaaagaaaaagaaaaraaagaatcaaaagtgctcctaaactggcaggatgggcatgggtgggggggtggaggaacacactattttcagacttcttttcaaatagtatttaggaaaa

SEQ ID NO: 83145 - DNA, 201 bp, Homo sapiens
gctctagaaacctttaatggaactgggaaacgttagtttggggcctcctgcctgttggcagacatagccaacctccaagcacctctaattcccatctaacyaacattacattgtaggatgcctgataaagccaagcacacaagaatactaacaacagtaagcacaaattgttaatagacctttaaaaaaaatcagaacccg

SEQ ID NO: 83146 - DNA, 201 bp, Homo sapiens
aacatccatgcatgactgatttgtaaccagagaagaaatgaattagaaaaatataaaaaataactgaacactctaagcactttttctcccaataaagcaamaaaaaaaaaaaaaaaaaaaagagagagagagagagaaagaaaattcctgctagcaaagggaaagcagaacggtaaataaatgcctataatcccagcactt

SEQ ID NO: 83147 - DNA, 201 bp, Homo sapiens
ctcctttgtaacatatacttctcagtaataaatggccagtgctctccagacatcctagcatcaacaacttctgggattgcagggtaccaaaaagctctggkggaacatacccttgtagaatccctcccacatccttgataacctgaggtgcagtaaactggggatgataggatgaatgccaggaaactaaaacaagtaggg

SEQ ID NO: 83148 - DNA, 201 bp, Homo sapiens
acggtaaataaatgcctataatcccagcactttaggaggccgaggagggtggatcacctgaggtcagagttcaagaccagcctggccaatatggtgaaacygtctctactaaaaatacaaaaattagttgggcgtggtggcagacgtctgtaatcccagctacttgggaggctgaggcagaagaattgccaataaggggga

SEQ ID NO: 83149 - DNA, 201 bp, Homo sapiens
cccagctacttgggaggctgaggcagaagaattgccaataagggggaaaaactcaaatgtccatggatagtcaaatggataaagaaaacatggaccaggcrcagtggctcacacctataatcccagcactttgggaggccaaggtgggcggatcacttgaggtcaggagttcaagacccgcctggccaacatggcgaaacc

SEQ ID NO: 83150 - DNA, 201 bp, Homo sapiens
atgatctcggctcactgcaacctccctctcccaggcgcaagcaattctcttgcctcagcctcccgagtagctgggtttacaggcatgtgccaccacgcccrgctaatttttatatattttttagtagagatggggtttcaccatgttggccaggctgatcttgaactcctgacctcaggtaatccgcccaccttggcctcc

SEQ ID NO: 83151 - DNA, 201 bp, Homo sapiens
ttacccttaactaaaatatatccagattgttaaagaagactttgatgccttaacataaggaagcaaccaatgctgcaaataatagagaacagcaatgaaaytttcaggggtggctggggggtgtaggcttttagttccaaaaatacaccataggcggcctacctcacctagaaataccatcaaacccacacagtggccatg

SEQ ID NO: 83152 - DNA, 201 bp, Homo sapiens
gtgcgtgcgtgcgtgcgtgcgtacgtgcgcgccctcccgcccgcccgcctcagtggccgggcgggggtcggcccgcgctctgagtgccgccgccacagttmgcagttgtgactctgtaggcggaagcatagggacaagcctgagcgtcacaggctccccacaaacaaccgcgtgacccggggactttccccagggtgtgca

SEQ ID NO: 83153 - DNA, 201 bp, Homo sapiens
ggggtgtaggcttttagttccaaaaatacaccataggcggcctacctcacctagaaataccatcaaacccacacagtggccatgcctgacttctccataamctgaatcaagccaagtatatataatgacctccgccggatacattctctacaggtgagtggggtaaactggcactgcggtcctggcatggtggagagtgca

SEQ ID NO: 83154 - DNA, 201 bp, Homo sapiens
ctgaggtgggaggatcaatagagcctaggagttcaagggagcagtgagctatgatcatgccattacactccagcctgggtgacagagtgagactccatctytgaaaaaaattagaaatgacgcacatgggttaaatggtatatggcaaactaacagtttgagtatggacaaaaattcaattagaagaaaggatcccagagg

SEQ ID NO: 83155 - DNA, 201 bp, Homo sapiens
ttgtaaccagagaagaaatgaattagaaaaatataaaaaataactgaacactctaagcactttttctcccaataaagcaaaaaaaaaaaaaaaaaaaaaargagagagagagagagaaagaaaattcctgctagcaaagggaaagcagaacggtaaataaatgcctataatcccagcactttaggaggccgaggagggtgg

SEQ ID NO: 83156 - DNA, 201 bp, Homo sapiens
gtaaccagagaagaaatgaattagaaaaatataaaaaataactgaacactctaagcactttttctcccaataaagcaaaaaaaaaaaaaaaaaaaaaaagrgagagagagagagaaagaaaattcctgctagcaaagggaaagcagaacggtaaataaatgcctataatcccagcactttaggaggccgaggagggtggat

SEQ ID NO: 83157 - DNA, 201 bp, Homo sapiens
aggaccgcgtcgcttacccagatgccgccgcggcggcaggccgactcctccgtgcaggaggggcgggctcccaagccgcgcactgcaagcagtggcgccgrctcacgcacccctcggccgcctctcgcgcggcttcccgcgccggcagcccgcgatggccccacgtgaccgcgtgtctggtagcaggggaaagaggggcgc

SEQ ID NO: 83158 - DNA, 201 bp, Homo sapiens
gagacagggtttcactgtgttagccaggatggctcgatttcctgaccttgtgatccacccgcctccgcctcccaaagtgctgggattacaggcgtgagccwcggtgcccggcctcaaaaatttttaatgaaaaaattatcttcaagagataagctaaaagtctcacaggaatttagatccctcctcccctgccgcatactc

SEQ ID NO: 83159 - DNA, 201 bp, Homo sapiens
cgtgaccgcgtgtctggtagcaggggaaagaggggcgccagggccggggtgtgcgtgcgtgcgtgcgtgcgtacgtgcgcgccctcccgcccgcccgcctyagtggccgggcgggggtcggcccgcgctctgagtgccgccgccacagttcgcagttgtgactctgtaggcggaagcatagggacaagcctgagcgtcaca

SEQ ID NO: 83160 - DNA, 201 bp, Homo sapiens
tgaccgcgtgtctggtagcaggggaaagaggggcgccagggccggggtgtgcgtgcgtgcgtgcgtgcgtacgtgcgcgccctcccgcccgcccgcctcaktggccgggcgggggtcggcccgcgctctgagtgccgccgccacagttcgcagttgtgactctgtaggcggaagcatagggacaagcctgagcgtcacagg

SEQ ID NO: 83161 - DNA, 201 bp, Homo sapiens
cagacttgggcgcgctccgagggaggaggcgtaagatccgtgcaaattcttgttacgctgtttcccaccccctctcgccggcacacacgctttttgttcaktaaaaagtggaaggtctgagtttgggaattttaagtggaaaagatctgtttcttgggaagggagtgctttcgcttgcagcggtgggcgcttactagaagt

SEQ ID NO: 83162 - DNA, 201 bp, Homo sapiens
taaactgatttttaaatgatatctgggaggttcagacccaaagaaccaatcggcatgagtaaaactgcaggggaagtaagaaatttatgaagtatactggrtgtgtgtggaggagggtgaaggtggtgatgagcagttttatgttgcttgaacatgaagtttgaagcaggcagtaactaaacatgtaagactagatgggtg

SEQ ID NO: 83163 - DNA, 201 bp, Homo sapiens
ctagccttagtgtaactcttggcattatatagcttgttttccttatccaaatgacattaagtcctttgagtcacattggaggttctgctctcagacctgakcccttgacttctagttgtgctaaacttgtcctaccagtgatgcagctagtagtacaaacaaaagcaatcacagatttcagtcgtaaaaacaagaacagct

SEQ ID NO: 83164 - DNA, 201 bp, Homo sapiens
gactttaatatttttgttttacataggtctctaattaacagaagatggcaaagcccagccacagcagctatgtccttcagcagctaaacaaccaaagagartggggttttctctgtgactgctgtattgcaattgatgacatttactttcaagcacacaaggcagttctagctgcctgtagctcctattttagaatgtttt

SEQ ID NO: 83165 - DNA, 201 bp, Homo sapiens
aatacaagctgtccatttacttaaaaccttttataggctttactagaacataaagttcattaactttttttggcagcattaataaagaggtcaaaaaaatkaaaaaagagcaaactcctcttggaatttgagtgaaattataatttaatgaaagtgaatgcctcataattttttttttttttttttgagatggagtcttgc

SEQ ID NO: 83166 - DNA, 201 bp, Homo sapiens
atgactttgggagctagaaagggggttcctcctcttaaagaaacaggaaactgggccgggcgcagtggctcacgcctgtaatcccaacactttgggaggcygaggcgggtggatcacccgaggtcaggagttcgagaccagcctggccaacatggcgaaaccccatctctactaaaagtacaaaaattagcctggcgtggt

SEQ ID NO: 83167 - DNA, 201 bp, Homo sapiens
ttttgtatttttagtagagacagggtttcactgtgttagccaggatggctcgatttcctgaccttgtgatccacccgcctccgcctcccaaagtgctgggwttacaggcgtgagccacggtgcccggcctcaaaaatttttaatgaaaaaattatcttcaagagataagctaaaagtctcacaggaatttagatccctcct

SEQ ID NO: 83168 - DNA, 201 bp, Homo sapiens
ccagagataatcaccatgtacagttaattccttgtttaaaacgagagaaggcaacatttgatcacagctgtgtgtgcctcactctgcctggggatggcctrtggtgattcatggactcatgttctctgttcacattactcaggttggtaagaattgccaggtagaggaaaggggagtgttttgcattgggctgatttaaaa

SEQ ID NO: 83169 - DNA, 201 bp, Homo sapiens
actaaatgtcagacattcagtaatgactgagatactgccctgatgtcaaggagcttgcagtaaagcaggggagccaaataattgcaatatctgccttaagygtggtaacagagcatcacagttgggatgatgcattattggtaccatattgttgtatgtataggctgttttggcagcacagaagaggcatctgcctcaccc

SEQ ID NO: 83170 - DNA, 201 bp, Homo sapiens
ggtagaaaggattaccatcccttcttagagaattgaagcacaaattgactaagcaaccttctcaaggtcacacacttaataagtggcagagccagaatttraacccaggcagtctggttagtttgtgctttaacacctactttatgtagctgttctgattattaaaatacagtgtaaaaagtgcaaaataaagaggtaata

SEQ ID NO: 83171 - DNA, 201 bp, Homo sapiens
gacggcccagctgctgggcccaacgggcaggggtctgacatctggacggagtgggaaagcagcctcgcatcctgccctggggagtcgggaggagcccagtyccatccagctgtgcaaacaggaggaggaggaggtcccaagcctacccttgagaggggcaagaggggtggtcaagccgccgccgccgcgacggcccccgcg

SEQ ID NO: 83172 - DNA, 201 bp, Homo sapiens
aaattttctaaacttgatcgtgtttgtcacttaagtgcgttgaaataaaacctcttatctttgggagcctctacaactggttattcctggaagtttcaagragaaacctagagaatgtaatagagattggaccctataccctgcaagatggtattctaggaaagaattttgccaatgtgacattatttttatagatggcag

SEQ ID NO: 83173 - DNA, 201 bp, Homo sapiens
gttgcccaggctggagtgcagtggctcaatctcagttcactgcaacctctgcctccaggttcaagcgattctcctgcctcagccccccaagtagctgggaytacaggcatccactatcatgcccggctgatttttgtatttttgtagagacagagtttcaccatgttggtcaggctggtcttgaactcctgacctcaggtg

SEQ ID NO: 83174 - DNA, 201 bp, Homo sapiens
caaagggaaagcagaacggtaaataaatgcctataatcccagcactttaggaggccgaggagggtggatcacctgaggtcagagttcaagaccagcctggccaatatggtgaaaccgtctctactaaaaatacaaaaattagttgggcgtggtggcagacgtctgtaatcccagctacttgggaggctgaggcagaagaat

SEQ ID NO: 83175 - DNA, 201 bp, Homo sapiens
tcataattttttttttttttttttgagatggagtcttgctctgtcgcccaggctggagtgcagtggcacagtcttggctcactgtaagctccgcctcccgrgttcccgccattctcccgcctcagcctcccaagtagctgggaatacaggtgcctgccaccacgcccggctaattttttgtatttttagtagagacagggt

SEQ ID NO: 83176 - DNA, 201 bp, Homo sapiens
ctcaactttccttactactcccatctcctttgtaacatatacttctcagtaataaatggccagtgctctccagacatcctagcatcaacaacttctgggaytgcagggtaccaaaaagctctgggggaacatacccttgtagaatccctcccacatccttgataacctgaggtgcagtaaactggggatgataggatgaat

SEQ ID NO: 83177 - DNA, 201 bp, Homo sapiens
ctattcagaaggtgtgaggtggaaggattgcttggagaatgagtacccatattaaagcaggaacagaatgctattgaggacattctgagctatgatggcaygccagcctgggtaacagagtaagaccctgtctcaaaaaaataataattaaaatttaagaaaaaagcttttctgaatgaggtgtaacaaggacagagtttc

SEQ ID NO: 83178 - DNA, 201 bp, Homo sapiens
tggggtaatcacttgctcaatagcatccaaccaacaaaccctgtattaaggactcatgccctgtccttgtttagtgttctttccggaagaccatactgtayagtaccaaggaagtgccatatatagaggttattactatctgggtggtcaggagtccttagtcctagtatgtgcttcagcacagttaactataccctgata

SEQ ID NO: 83179 - DNA, 201 bp, Homo sapiens
ctttatgtcttagaggtggcaggatgggcatataggtagtaaaaggggcgtatgacccatatgtgatcgctgaggaatggataaaaagcaaatagaagtaygtaaacgtagatacccttaattactactacagagcttgaagagtgaacattttatttctctaaacagcttgttacatgttctttttaagttcagtcaaat

SEQ ID NO: 83180 - DNA, 201 bp, Homo sapiens
tctatactactatgttaaacctactactttaatgatctggctaccgtctgccaaatgtcacttttcaagtgagaacagaagaatgagattgtgaagattcygtggacaatgtctatataatcatttaagtgttaaatataaactaaatgacaatagcagcttgtaaattaatgctaattctggctgggagcagtggctcag

SEQ ID NO: 83181 - DNA, 201 bp, Homo sapiens
aagccaacaggtggtgtgcagagccaagttcaacggtaaatacaccacataatagagaggctgatgaagagtctttacaattaggtaattttcctgagccrctatttgatgtatgtaaaaaaagttccgtgtccaaattatctactccaaaagaacgtgtgtcaagacgctttgggcggagttttacctgtgatagctgtg

SEQ ID NO: 83182 - DNA, 201 bp, Homo sapiens
actttaatatttttgtttaggattttaagtatctacatttaggtattaaatgtttatcatttttgttgtttcttaatagaattatttgtttttagtttttyttagctatgattaaaatttttaaatgtagactacaagtggttgttacccattcaatgactattaaactttagtttttcatcaataaggtgatgacttcac

SEQ ID NO: 83183 - DNA, 201 bp, Homo sapiens
gggccctcagaaaggaagacattcttctaggggtgacctgttcccatcaggaacccagaccatagggagcctcctaagctcaccagagaggatcagcccaycagctaccccttctgtgggctcttgtgtggaatggttctatagatgtccatgggcctggccctcccctgcctggctccacccactccaggatgtttccaa

SEQ ID NO: 83184 - DNA, 201 bp, Homo sapiens
agggctttctgcctcctgcacaggtaagaggtgaggggattcccaggggcttacctgcgagcagctgcatgccttccctaccctgacttgttcacagtgcrgcatcaggcccagagcctctgtggccccagagcagccagggcttctgcttacctcctttatgatcagagtcatgatagggttagcctgggcaaggtgctg

SEQ ID NO: 83185 - DNA, 201 bp, Homo sapiens
ggccccttcctgcccactgtgccaaagagtatgggctacaggagggagattctgatggagggtggttctgaagggcctggagacagtgagaggagccacaygccggatctctgtgccgctcaaaggacacaggaagagaacagccccacccctaccctgccacccacagccagcacatccagccatgtccccagagctcta

SEQ ID NO: 83186 - DNA, 201 bp, Homo sapiens; identical to SEQ ID NO: 64395

SEQ ID NO: 83187 - DNA, 201 bp, Homo sapiens
agaacagccccacccctaccctgccacccacagccagcacatccagccatgtccccagagctctatcccaggcagcaggccccggcctagaaggatgtccsaggttgggggaggtcacggtcaaaggaccctcataagggagcatggagtcagaccctgaagagactcccacccctctggctggcaggaaagaatgacatc

SEQ ID NO: 83188 - DNA, 201 bp, Homo sapiens
accgctggaccatcctgcactacagccccttcaaggccgtgtgggactggctcatcctgctgctggtcatctacacggctgtcttcacgccctactcagcmgccttcctgctcagcgaccaggacgaatcacggcgtggggcctgcagctatacctgcagtcccctcactgtggtggatctcatcgtggacatcatgttcg

SEQ ID NO: 83189 - DNA, 201 bp, Homo sapiens
tgttcgtcgtggacatcgtcatcaacttccgcaccacctatgtcaacaccaatgatgaggtggtcagccacccccgccgcatcgccgtccactacttcaarggctggttcctcattgacatggtggccgccatccctttcgacctcctgatcttccgcactggctccgatgaggtgagcagaccccctccaggccagcagc

SEQ ID NO: 83190 - DNA, 201 bp, Homo sapiens
ccaaaacggaaggtggttgtcgtccgttcccaagctggtttgaaactaggggtcgggctcggccgtcgtcgttgtttgtcgccgcatccccgcttccgggktaggccgttcctgcccgccccctcctctcctcccttcggacccatagatctcaggctcggctccccgcccgccgcagcccactgttgacccggcccgtac

SEQ ID NO: 83191 - DNA, 201 bp, Homo sapiens
cggtgagccccgccgctccggctaatgccccgggcgtggggggggagccaagatcctgcgggggcggggcgtccccagagccctcaccaccctctcccccagccccaccccggccgcgtcccgctggacttggccgcccgccttgcaggtgctgaagggcttccccgagtgcctgcaggctgacatctgcctgcacctgca

SEQ ID NO: 83192 - DNA, 201 bp, Homo sapiens
gcccagtacccttgccacataccacatacctgaacatcacccatgtctaccctgggatattcccccttgccttgcatggacctagtcaggtgcctcttgctttttttttttttttttttttgagatggagtctcgctctgtcacccaggctggagtacagtggtgtgatctcagctccctgcaaactctgcctcccgggtt

SEQ ID NO: 83193 - DNA, 201 bp, Homo sapiens; identical to SEQ ID NO: 64422

SEQ ID NO: 83194 - DNA, 201 bp, Homo sapiens; identical to SEQ ID NO: 12936

SEQ ID NO: 83195 - DNA, 201 bp, Homo sapiens
tgcttgaacccaggaggtggaaattgcagtaaaccaagatcacgccactgtactccagcctgggtggcagagcgagactctgtctttaaaaaaaaaaagtrccatcacatgggagggatgattattattattaataattaagaagttaatccaatttaagtttcagttagagacatgaaacctctcattttgtcctgagta

SEQ ID NO: 83196 - DNA, 201 bp, Homo sapiens
tgccctggctgtctctcatgttgggcagctgggcagagccagggcatgttgtgctgggacctagagatcctgggttgatcacagtcttggaggcgggggcrggaggggagaagggagaagggaaggctctgcagaaggtgatgattccaaacccttggagatgtggggaggagtcagttttccttggtgcccaggacccgt

SEQ ID NO: 83197 - DNA, 201 bp, Homo sapiens; identical to SEQ ID NO: 64428

SEQ ID NO: 83198 - DNA, 201 bp, Homo sapiens; identical to SEQ ID NO: 64303

SEQ ID NO: 83199 - DNA, 201 bp, Homo sapiens
tgacatctttggggaacccgtcagcctccatgcccagccaggcaagtccagtgcagacgtgcgggctctgacctactgcgacctgcacaagatccagcggrcagatctgctggaggtgctggacatgtacccggcctttgcggagagcttctggagtaagctggaggtcaccttcaacctgcgggacgtgagtcagggcca

SEQ ID NO: 83200 - DNA, 201 bp, Homo sapiens
gtggctcagacacatcacagggtgccaggtgggttttagaatggggcaggccatttagctgcaggtctccccatacctgtcattaagcacaattcccccartgacttcccctagcaaactctggaacatgccaagggagcttctcgggggaggggcacaaccatgtgcagaaacaaattccataggtcctgggaaagggag

SEQ ID NO: 83201 - DNA, 201 bp, Homo sapiens; identical to SEQ ID NO: 64444

SEQ ID NO: 83202 - DNA, 201 bp, Homo sapiens; identical to SEQ ID NO: 64445

SEQ ID NO: 83203 - DNA, 201 bp, Homo sapiens; identical to SEQ ID NO: 64446

SEQ ID NO: 83204 - DNA, 201 bp, Homo sapiens; identical to SEQ ID NO: 64447

SEQ ID NO: 83205 - DNA, 201 bp, Homo sapiens
atggcagggctatggtggcagagcgagggcttagaggcagaacagtccaggttcaaattctggctctgttccctaccagcaagagtgtgggcaagttactwaacagctctgaacctagtttgcccttttgtgaaatggggataattggaacatccacatcaaagcatcttggggactgaatcttgtatgcttggtgcctgc

SEQ ID NO: 83206 - DNA, 201 bp, Homo sapiens
cagcagcccctgcccgccctgcccttcccaggcacggctctcactgctcctccatctcccatgtgcgcatcgggctgcagtgccacactcggtttcccatrtcggccacgcacttcacacctcagtgccgctgctcatgctgctccctgagccaggagtgccctttccctctctctcctgtctgtctggagccctagcctc

SEQ ID NO: 83207 - DNA, 201 bp, Homo sapiens
gatacatttaaatagatgcaaaggatataatctcaagtgtcttgtaaatattgacactttataaaacaattccatccttcatttgtattgacccatttctmcccaaatagcagcgatttgagagccaccaccatctattttaaaaacacaagaaacccttctttaacatcattcttttttcttttctcataattcccactt

SEQ ID NO: 83208 - DNA, 201 bp, Homo sapiens
catgtgccctggcgctgtcctggtcactcctgacttctccctggacagaggggtccttcaccagggggctgctggaaggaggaagacctgggtaagccctkggtggtgtggcccagtggggccgcggaggagctcactctccgccccgcccccagccctgatgtacgccagcatcttcgggaacgtgtccgcgatcatcca

SEQ ID NO: 83209 - DNA, 201 bp, Homo sapiens
cgccgcgcatccaccgctggaccatcctgcactacagccccttcaaggccgtgtgggactggctcatcctgctgctggtcatctacacggctgtcttcacrccctactcagccgccttcctgctcagcgaccaggacgaatcacggcgtggggcctgcagctatacctgcagtcccctcactgtggtggatctcatcgtgg

SEQ ID NO: 83210 - DNA, 201 bp, Homo sapiens
cttccaaatcctcctagcctcctgtctgcctacccaacaggccacaggcatgggggcagggcatggggtaccacgcactggcaccccaccccagccccagmcctcactgctataacgggctggtctttggtccattcccagccgcagttttccaattgcatcaattttccagtaacatcaattgctgggtgcagccacgcc

SEQ ID NO: 83211 - DNA, 201 bp, Homo sapiens
ctttcttgctcctcccagaccccaagctatggagacttggatgactgtagtccaaagcacaggaactcctcccccaggatgcctcacctggctgtggcaayggacaaaactctggcaccatcctcagaacaggaacagcctgaggggctctggccacccctagcctcacctctacatcccctggaagtacaaggactcatc

SEQ ID NO: 83212 - DNA, 201 bp, Homo sapiens; identical to SEQ ID NO: 64453

SEQ ID NO: 83213 - DNA, 201 bp, Homo sapiens
gtcacccaccctctcccactacaccttccccaggcctcagccctctaggccagtctcaccagcagtggctgccccgtgcctgacctccctcggcccccacmcccaggtcctgtccctgggcgcggatgtgctgccggagtacaagctgcaggcgccgcgcatccaccgctggaccatcctgcactacagccccttcaaggc

SEQ ID NO: 83214 - DNA, 201 bp, Homo sapiens
agagccgtggtcacccaccctctcccactacaccttccccaggcctcagccctctaggccagtctcaccagcagtggctgccccgtgcctgacctccctckgcccccacccccaggtcctgtccctgggcgcggatgtgctgccggagtacaagctgcaggcgccgcgcatccaccgctggaccatcctgcactacagccc

SEQ ID NO: 83215 - DNA, 201 bp, Homo sapiens
cagcagccatggctgtcctctgcacgctggcctcaagccctccctgctgcacagcactgggtgcggagagtatctggcactgggcacctttgctgaagcaygtggaggtggagaggaggccccaaacatctgtcacctcccagccctggagaaggacctgccaaggctgcacccccaggcctctgtccctctgccccctct

SEQ ID NO: 83216 - DNA, 201 bp, Homo sapiens
agagtgagggtggtggtgggagggacgcatgagggtcccctggccgtggctgctctgactcctggccctggtttcagagggctctcacggcaggccaggcrgaccagggccaggcacaggcaggggcaagtacaggaccatcagccagatcccacagttcacgctcaacttcgtggagttcaacttggagaagcaccgctc

SEQ ID NO: 83217 - DNA, 201 bp, Homo sapiens; identical to SEQ ID NO: 64347

SEQ ID NO: 83218 - DNA, 201 bp, Homo sapiens; identical to SEQ ID NO: 64349

SEQ ID NO: 83219 - DNA, 201 bp, Homo sapiens; identical to SEQ ID NO: 64475

SEQ ID NO: 83220 - DNA, 201 bp, Homo sapiens
gagacctaaagacctgaaggcctgccctgaggtcacagcccttgtgcccagctcctagagccagaggaggctggggtcagtagggcctgtgaatgatgccrcctcctaggcctggagaagccagggcaggggatggacatggaggccaccatgggggcctgaccaaggctcagcccgtcacagggaaggagaggcagagag

SEQ ID NO: 83221 - DNA, 201 bp, Homo sapiens
ccagccctgtgccagccctttgcctttgagacaaaagccaccctccctacttccttccaatgtgaacacaggatcctcctgcatgccaggcagggcaggaygaggctggcacctccagctatctttaatcagcttcctgggggccaggccctgaaggaccccggcagctcctccttggccaccccaaggcaggcttccctg

SEQ ID NO: 83222 - DNA, 201 bp, Homo sapiens
gctccagtgaccacagtcctggcactgactccctgtgtgaccttggccaggggaactatcagccccctttctaggcctcagggctttcatctgcaggagasagatggactaaatggtctctggggacccatttgacattgagtagttctggccccaggaggcagacaaagctgtaagtcatagccaggggcccaggccaag

SEQ ID NO: 83223 - DNA, 201 bp, Homo sapiens; identical to SEQ ID NO: 64361

SEQ ID NO: 83224 - DNA, 201 bp, Homo sapiens
cctgttcccatcaggaacccagaccatagggagcctcctaagctcaccagagaggatcagcccaccagctaccccttctgtgggctcttgtgtggaatggktctatagatgtccatgggcctggccctcccctgcctggctccacccactccaggatgtttccaagggagcttgtgagcatcaaacctggtgtcgctatgg

SEQ ID NO: 83225 - DNA, 201 bp, Homo sapiens; identical to SEQ ID NO: 64478

SEQ ID NO: 83226 - DNA, 201 bp, Homo sapiens; identical to SEQ ID NO: 64362

SEQ ID NO: 83227 - DNA, 201 bp, Homo sapiens
actacagccccttcaaggccgtgtgggactggctcatcctgctgctggtcatctacacggctgtcttcacgccctactcagccgccttcctgctcagcgaycaggacgaatcacggcgtggggcctgcagctatacctgcagtcccctcactgtggtggatctcatcgtggacatcatgttcgtcgtggacatcgtcatca

SEQ ID NO: 83228 - DNA, 201 bp, Homo sapiens
cttggaggcccgctgctacagcacgctcgcctccaggccacccacgcccccaccacccgcactgagccgttatctgcctgactgacatcttggccaaccartgacctttggggctgccaaagcgcctgcctccgagagttgggcggggcgagtagttgcaatgacaaacatttaacccaatagcgaggagatttcagacgc

SEQ ID NO: 83229 - DNA, 201 bp, Homo sapiens; identical to SEQ ID NO: 64363

SEQ ID NO: 83230 - DNA, 201 bp, Homo sapiens
tcaccagggggctgctggaaggaggaagacctgggtaagccctgggtggtgtggcccagtggggccgcggaggagctcactctccgccccgcccccagccytgatgtacgccagcatcttcgggaacgtgtccgcgatcatccagcgcctgtactcgggcaccgcgcgctaccacacgcagatgctgcgtgtcaaggagtt

SEQ ID NO: 83231 - DNA, 201 bp, Homo sapiens
tggagaggccgctcagaacagcagcagcggaggggaagtcagcgcaggtcacagacggtttcactctcagagacttggcctagaacttggaggcccgctgytacagcacgctcgcctccaggccacccacgcccccaccacccgcactgagccgttatctgcctgactgacatcttggccaaccaatgacctttggggctg

SEQ ID NO: 83232 - DNA, 201 bp, Homo sapiens
cgggcaggggctcggaacccagctggcggggagcgggccccgggagcgccctttccgggccggagcccaggcctcagaaccctcttgcggactcgccctakggccacggagcggttcctctgtctggccctgtgctgaaggtttcgtactcgttgtctgtctcctttaatccaggcagcattcttgtgtagtcggcagtgt

SEQ ID NO: 83233 - DNA, 201 bp, Homo sapiens
catccctgaaatcagggtggattaacccgcagcctggcctggggtgcatccctctttcttgctcctcccagaccccaagctatggagacttggatgactgyagtccaaagcacaggaactcctcccccaggatgcctcacctggctgtggcaacggacaaaactctggcaccatcctcagaacaggaacagcctgaggggc

SEQ ID NO: 83234 - DNA, 201 bp, Homo sapiens
ttcctgggcatggccgccctagtattctatgaacagatcaaactcaatgtatcccaacctgaaatcacctttcctcaaaaccagctgcttcagcatccccrtcactgtgaagcatctgcctattgcccacgccacagtctgccaagggggcatcctacttcattcctgcccactgtccaccagccagacttgtccatacct

SEQ ID NO: 83235 - DNA, 201 bp, Homo sapiens
tgggggacactgggcagggtgggctttgccacgaagagcctcgagctggctttggaggcagtgggagattttgggggtccccctgtctgggggccctgagragctgaggaactctattctcagcctactttaaaccaccccccaccattccttctgtctccctcccactccccacccaggcaggcctagggaagggccttg

SEQ ID NO: 83236 - DNA, 201 bp, Homo sapiens
gggttaggccgttcctgcccgccccctcctctcctcccttcggacccatagatctcaggctcggctccccgcccgccgcagcccactgttgacccggcccktactgcggccccgtggccaccatgtccctgcacggcaaacggaaggagatctacaagtatgaagcgccctggacagtctacgcgatgaactggagtgtgc

SEQ ID NO: 83237 - DNA, 201 bp, Homo sapiens
agcaggaccctgaggtgtgggaagggcaggtacaatttttgcctgatcccatccctgaaatcagggtggattaacccgcagcctggcctggggtgcatccytctttcttgctcctcccagaccccaagctatggagacttggatgactgtagtccaaagcacaggaactcctcccccaggatgcctcacctggctgtggca

SEQ ID NO: 83238 - DNA, 201 bp, Homo sapiens; identical to SEQ ID NO: 64490

SEQ ID NO: 83239 - DNA, 201 bp, Homo sapiens
gctccggtgaggcagagtgagggtggtggtgggagggacgcatgagggtcccctggccgtggctgctctgactcctggccctggtttcagagggctctcayggcaggccaggcggaccagggccaggcacaggcaggggcaagtacaggaccatcagccagatcccacagttcacgctcaacttcgtggagttcaacttgg

SEQ ID NO: 83240 - DNA, 201 bp, Homo sapiens
cagggagccgaggccgcaccactgcactccagcctgggtgacagagtgagactccaactcaaaaaaaaaaaaaaaaaagatcttggggaggcagacagccycccagatgggcctctcctaaagtagctacaaactgctgatccaggtgacccaggatggcgtgggtgaagaagctcacgacttttcccagcctcctccagg

SEQ ID NO: 83241 - DNA, 201 bp, Homo sapiens
gcagcagcccctgcccgccctgcccttcccaggcacggctctcactgctcctccatctcccatgtgcgcatcgggctgcagtgccacactcggtttcccaygtcggccacgcacttcacacctcagtgccgctgctcatgctgctccctgagccaggagtgccctttccctctctctcctgtctgtctggagccctagcct

SEQ ID NO: 83242 - DNA, 201 bp, Homo sapiens
tgtacacatgaagccagctctgccaggcactcttttaaacactttacaaaagcccacatttcattcccttctgagcctggtttacaaagcaagaacccagrtagtgctaaagtgccagagggcacacagctaggaaatgtccgagtgactcaatcccagcccaggggttcagctccaaggctgtgctgttctcaatccctg

SEQ ID NO: 83243 - DNA, 201 bp, Homo sapiens; identical to SEQ ID NO: 64494

SEQ ID NO: 83244 - DNA, 201 bp, Homo sapiens
gaagacccagattgctggcctctgaagctgggctccaggctagagcagctccaggcccagatgaacaggtgtgtgtgctgtggtcagggctgggggctggkcatgggtagcccctcctagtggctcagacacatcacagggtgccaggtgggttttagaatggggcaggccatttagctgcaggtctccccatacctgtca

SEQ ID NO: 83245 - DNA, 201 bp, Homo sapiens
agtatgtctttcaaagggcttaagtctttttacacaaattaatgttttttcttgtaagtttttccagggtcgttgggtaagcaatagttactcctattccycagagaggagaaactgagccacagttaggctgcttggtaggatcagtggagtagtcaaactgctgttgcaggaactctaccccagtttgtcctttcattt

SEQ ID NO: 83246 - DNA, 201 bp, Homo sapiens
aagagcctcgagctggctttggaggcagtgggagattttgggggtccccctgtctgggggccctgaggagctgaggaactctattctcagcctactttaamccaccccccaccattccttctgtctccctcccactccccacccaggcaggcctagggaagggccttgtttcaccctagcagggtcctagcagccctcagg

SEQ ID NO: 83247 - DNA, 201 bp, Homo sapiens
tttacatgtgagggtcttgtaaaaaagaaatttgaacatttcacagtttgtttacagtttttcaggagcacatttgtttctctagagtaggtcctctttgsagtccactttgagaagctgatgaaagctatggattctcattgtccagacattacacatacatgaacaatttacaaacaaatccaaggaatatgcactgat

SEQ ID NO: 83248 - DNA, 201 bp, Homo sapiens
taatcccaggactttgggaggccgaggcgggcggattacctgagctcaggagttcgcgaccagcctgggtaacacggtgaaaccccgtctctactaaaatmcaaaaaaaaaaaaaaaaaaaaaaaaaaaaaaagccgggcgtagcttagtgcgcctgtagtcccagctactcggaagtctgaggctggagaattgcttgaa

SEQ ID NO: 83249 - DNA, 201 bp, Homo sapiens
tcccagcgcctgttgtcccagagcttcctgggctccggtgaggcagagtgagggtggtggtgggagggacgcatgagggtcccctggccgtggctgctctkactcctggccctggtttcagagggctctcacggcaggccaggcggaccagggccaggcacaggcaggggcaagtacaggaccatcagccagatcccacag

SEQ ID NO: 83250 - DNA, 201 bp, Homo sapiens
ctgagttggcctcagagagggcactcactggtcctggatccccagggccctcagaaaggaagacattcttctaggggtgacctgttcccatcaggaacccwgaccatagggagcctcctaagctcaccagagaggatcagcccaccagctaccccttctgtgggctcttgtgtggaatggttctatagatgtccatgggcc

SEQ ID NO: 83251 - DNA, 201 bp, Homo sapiens; identical to SEQ ID NO: 62325

SEQ ID NO: 83252 - DNA, 201 bp, Homo sapiens
tcaaagctgcagtagccatgtttgtgccactgcactccagcctggataacagaacgagaccctgtctccctgtctcaaaatattaatgtgtgtgtgcgtgygtgtgtgtgtgtgtgtgtgtgtgtgtgttttggtctccatcctggctcctggccagacctcctaaagcccttgtaatttcctaaatgataaagtgaaggg

SEQ ID NO: 83253 - DNA, 201 bp, Homo sapiens; identical to SEQ ID NO: 62206

SEQ ID NO: 83254 - DNA, 201 bp, Homo sapiens; identical to SEQ ID NO: 62207

SEQ ID NO: 83255 - DNA, 201 bp, Homo sapiens; identical to SEQ ID NO: 62338

SEQ ID NO: 83256 - DNA, 201 bp, Homo sapiens; identical to SEQ ID NO: 62339

SEQ ID NO: 83257 - DNA, 201 bp, Homo sapiens; identical to SEQ ID NO: 62341

SEQ ID NO: 83258 - DNA, 201 bp, Homo sapiens; identical to SEQ ID NO: 62343

SEQ ID NO: 83259 - DNA, 201 bp, Homo sapiens
cactttgggagggcgaggtgggcgaatcatgagatcaggagttcaagaccagcctggccaacatagtaaaaccccgtctcactaaaaatacaaaaaattakccagctgggcgtggtggcaggtgcctgtaatcccagctactctggaggctgaggcaggagaatcacttgaacccgggaggtggaggttgcagtgagtgga

SEQ ID NO: 83260 - DNA, 201 bp, Homo sapiens; identical to SEQ ID NO: 62212

SEQ ID NO: 83261 - DNA, 201 bp, Homo sapiens; identical to SEQ ID NO: 62214

SEQ ID NO: 83262 - DNA, 201 bp, Homo sapiens; identical to SEQ ID NO: 62216

SEQ ID NO: 83263 - DNA, 201 bp, Homo sapiens; identical to SEQ ID NO: 62217

SEQ ID NO: 83264 - DNA, 201 bp, Homo sapiens
tgaacatggtggtgcgcacctgtagtcccagctacttgggaggctgaggcaggagagtcgcttgaacccaggatgtggaggttgaagtgagccaagatcgygccactgcactccagtctagcgacagatggagactctgtctcaaaaaaaaaaaaataagtatttttctttctagccgtatatccaccttacatggtccct

SEQ ID NO: 83265 - DNA, 201 bp, Homo sapiens; identical to SEQ ID NO: 62219

SEQ ID NO: 83266 - DNA, 201 bp, Homo sapiens; identical to SEQ ID NO: 62358

SEQ ID NO: 83267 - DNA, 201 bp, Homo sapiens; identical to SEQ ID NO: 62225

SEQ ID NO: 83268 - DNA, 201 bp, Homo sapiens
ggaggccaaggtgggaggatcacaaggttaggagttcaagaccagcctggccaacttggtgaaaccccatctctactaaaaatacaaaaattagccgggtrtagtggtgatcgcctgtaatcccagctattcgttaggctgaggcaggagaatcgcttgaacccgggaggcagaggttgcagtgagctgagattgtgccac

SEQ ID NO: 83269 - DNA, 201 bp, Homo sapiens; identical to SEQ ID NO: 62231

SEQ ID NO: 83270 - DNA, 201 bp, Homo sapiens; identical to SEQ ID NO: 62364

SEQ ID NO: 83271 - DNA, 201 bp, Homo sapiens
ttgcttgagcccaagaagttgaggctgcagtgagctatgatggtgccactgcactccaacctggatgacagaacaagaaactgtctcaaaaaaaaaaaaawaaaaaaaaaaaaaaggtcaggcacggtggctcaggcctgtaatcccagcactttgggaggccaaggtgggaggattacttgagcccaggcagtcaagacc

SEQ ID NO: 83272 - DNA, 201 bp, Homo sapiens
ctgagatcccaagattcactagcccttgaataaaaaaaaggaaaaagaaaaaaacagtatattttttcgttttgcaaatcacagttcccttattaagatgraattgctgccaattacagagaagctatttgcctaagccaaaaatccatgaggttcacatggacttatagttacacaaattagaaacaaatgttatattta

SEQ ID NO: 83273 - DNA, 201 bp, Homo sapiens
gattcactagcccttgaataaaaaaaaggaaaaagaaaaaaacagtatattttttcgttttgcaaatcacagttcccttattaagatggaattgctgccawttacagagaagctatttgcctaagccaaaaatccatgaggttcacatggacttatagttacacaaattagaaacaaatgttatatttaaaaccatagaga

SEQ ID NO: 83274 - DNA, 201 bp, Homo sapiens
agctgcagtagccatgtttgtgccactgcactccagcctggataacagaacgagaccctgtctccctgtctcaaaatattaatgtgtgtgtgcgtgcgtgygtgtgtgtgtgtgtgtgtgtgtgttttggtctccatcctggctcctggccagacctcctaaagcccttgtaatttcctaaatgataaagtgaagggagct

SEQ ID NO: 83275 - DNA, 201 bp, Homo sapiens
cgttttgcaaatcacagttcccttattaagatggaattgctgccaattacagagaagctatttgcctaagccaaaaatccatgaggttcacatggacttayagttacacaaattagaaacaaatgttatatttaaaaccatagagaaatgcccaggtgatgaaagctggggtgaaggagtctgcacattcatttcaaactg

SEQ ID NO: 83276 - DNA, 201 bp, Homo sapiens
ttgtgccactgcactccagcctgggcaacagagcgagattctgtctcaacaaaaaaagctgggtgcagtggctcacgcctgtaatcctagcactttgggartccgaggtgggtagatcacctaaggtcaggagttcaagaccagcctggtcaacatggtgaaaccccgcctctacaaaaatacaaaaattagctaggtatg

SEQ ID NO: 83277 - DNA, 201 bp, Homo sapiens
gaggctgaggtaggagaattgcttgaacccaggaggcagtggttgcagtgagccgagattgcaccattgcactcccgcctgggcgacagagcaagactccractcaaaaaaaaaaaaaaaagcagcagcagcagccagaggccactccagcatctcccctacctggcttgggtcagggagagggcagtgagaagtgaaaac

SEQ ID NO: 83278 - DNA, 201 bp, Homo sapiens; identical to SEQ ID NO: 62233

SEQ ID NO: 83279 - DNA, 201 bp, Homo sapiens; identical to SEQ ID NO: 62235

SEQ ID NO: 83280 - DNA, 201 bp, Homo sapiens; identical to SEQ ID NO: 62234

SEQ ID NO: 83281 - DNA, 201 bp, Homo sapiens
agttcaagaccagcctggccaacttggtgaaaccccatctctactaaaaatacaaaaattagccgggtatagtggtgatcgcctgtaatcccagctattcrttaggctgaggcaggagaatcgcttgaacccgggaggcagaggttgcagtgagctgagattgtgccactgcactccagcctgggcaacagagcgagattc

SEQ ID NO: 83282 - DNA, 201 bp, Homo sapiens
agcagccagaggccactccagcatctcccctacctggcttgggtcagggagagggcagtgagaagtgaaaactcccagctacagaaaaggaaatatgttgsggggaagggagaaggaaaggtgtcttcatcaatgccggggcagggtagatggagccctgggcagggagtttggaccaggaaatctcaatgagggaaatgt

SEQ ID NO: 83283 - DNA, 201 bp, Homo sapiens; identical to SEQ ID NO: 62236

SEQ ID NO: 83284 - DNA, 201 bp, Homo sapiens
ggcgacagagcaagactccgactcaaaaaaaaaaaaaaaagcagcagcagcagccagaggccactccagcatctcccctacctggcttgggtcagggagasggcagtgagaagtgaaaactcccagctacagaaaaggaaatatgttggggggaagggagaaggaaaggtgtcttcatcaatgccggggcagggtagatgg

SEQ ID NO: 83285 - DNA, 201 bp, Homo sapiens
tcagagaacgcttctctaaccactctatttattttattattttattgtattttttgagacagggtctcactctgttgcccagactggagtgtaatggcacrgtcatggctcactgcagccttgatctcctgggctcaagcgatcctctcacttcagcctcccaagtggctaggaccacaggcgtaagccaccgtgtctggc

SEQ ID NO: 83286 - DNA, 201 bp, Homo sapiens
gaaggattgcttgagcccaagaagttgaggctgcagtgagctatgatggtgccactgcactccaacctggatgacagaacaagaaactgtctcaaaaaaawaaaaataaaaaaaaaaaaaaggtcaggcacggtggctcaggcctgtaatcccagcactttgggaggccaaggtgggaggattacttgagcccaggcagtc

SEQ ID NO: 83287 - DNA, 201 bp, Homo sapiens; identical to SEQ ID NO: 62256

SEQ ID NO: 83288 - DNA, 201 bp, Homo sapiens
tgcctagggaggcatgtgtcagaggctatcatccactctgttgaacccacagtgaccagcaccaccatcacacaaacatgcctgcatgtgtgcacgcacgygcagtgtgcaaacctgatgtcagcctcactccctggctcttctgtccacaaacgctgtttctttaagtaccactttcagttcctccaaagaatctactta

SEQ ID NO: 83289 - DNA, 201 bp, Homo sapiens; identical to SEQ ID NO: 62259

SEQ ID NO: 83290 - DNA, 201 bp, Homo sapiens
tgaagcctccataaaaaaaaacaaaaaagatgagggttggagagctgccaggttgatgaacacatggaggtgcagggaggtgcccagagaggacaagaaarctccaaatcccccttccccgatactttgtccggagcaactcttccatctgactgttcctaagttttatccttcataataaactagctaacataagtaaag

SEQ ID NO: 83291 - DNA, 201 bp, Homo sapiens; identical to SEQ ID NO: 62261

SEQ ID NO: 83292 - DNA, 201 bp, Homo sapiens; identical to SEQ ID NO: 62260

SEQ ID NO: 83293 - DNA, 201 bp, Homo sapiens; identical to SEQ ID NO: 62263

SEQ ID NO: 83294 - DNA, 201 bp, Homo sapiens; identical to SEQ ID NO: 62262

SEQ ID NO: 83295 - DNA, 201 bp, Homo sapiens; identical to SEQ ID NO: 62265

SEQ ID NO: 83296 - DNA, 201 bp, Homo sapiens; identical to SEQ ID NO: 62264

SEQ ID NO: 83297 - DNA, 201 bp, Homo sapiens
tgaggtaggagaattgcttgaacccaggaggcagtggttgcagtgagccgagattgcaccattgcactcccgcctgggcgacagagcaagactccgactcaaaaaaaaaaaaaaaagcagcagcagcagccagaggccactccagcatctcccctacctggcttgggtcagggagagggcagtgagaagtgaaaactccca

SEQ ID NO: 83298 - DNA, 201 bp, Homo sapiens; identical to SEQ ID NO: 62268

SEQ ID NO: 83299 - DNA, 201 bp, Homo sapiens; identical to SEQ ID NO: 62270

SEQ ID NO: 83300 - DNA, 201 bp, Homo sapiens; identical to SEQ ID NO: 62272

SEQ ID NO: 83301 - DNA, 201 bp, Homo sapiens; identical to SEQ ID NO: 62273

SEQ ID NO: 83302 - DNA, 201 bp, Homo sapiens
ggaaggattgcttgagcccaagaagttgaggctgcagtgagctatgatggtgccactgcactccaacctggatgacagaacaagaaactgtctcaaaaaawaaaaaataaaaaaaaaaaaaaggtcaggcacggtggctcaggcctgtaatcccagcactttgggaggccaaggtgggaggattacttgagcccaggcagt

SEQ ID NO: 83303 - DNA, 201 bp, Homo sapiens; identical to SEQ ID NO: 62275

SEQ ID NO: 83304 - DNA, 201 bp, Homo sapiens; identical to SEQ ID NO: 62274

SEQ ID NO: 83305 - DNA, 201 bp, Homo sapiens; identical to SEQ ID NO: 62276

SEQ ID NO: 83306 - DNA, 201 bp, Homo sapiens; identical to SEQ ID NO: 62278

SEQ ID NO: 83307 - DNA, 201 bp, Homo sapiens; identical to SEQ ID NO: 62279

SEQ ID NO: 83308 - DNA, 201 bp, Homo sapiens; identical to SEQ ID NO: 62280

SEQ ID NO: 83309 - DNA, 201 bp, Homo sapiens
gcttgaacccaggaggcagtggttgcagtgagccgagattgcaccattgcactcccgcctgggcgacagagcaagactccgactcaaaaaaaaaaaaaaargcagcagcagcagccagaggccactccagcatctcccctacctggcttgggtcagggagagggcagtgagaagtgaaaactcccagctacagaaaaggaa

SEQ ID NO: 83310 - DNA, 201 bp, Homo sapiens; identical to SEQ ID NO: 62410

SEQ ID NO: 83311 - DNA, 201 bp, Homo sapiens; identical to SEQ ID NO: 62411

SEQ ID NO: 83312 - DNA, 201 bp, Homo sapiens; identical to SEQ ID NO: 62412

SEQ ID NO: 83313 - DNA, 201 bp, Homo sapiens; identical to SEQ ID NO: 62413

SEQ ID NO: 83314 - DNA, 201 bp, Homo sapiens; identical to SEQ ID NO: 62414

SEQ ID NO: 83315 - DNA, 201 bp, Homo sapiens; identical to SEQ ID NO: 62297

SEQ ID NO: 83316 - DNA, 201 bp, Homo sapiens; identical to SEQ ID NO: 62299

SEQ ID NO: 83317 - DNA, 201 bp, Homo sapiens; identical to SEQ ID NO: 62303

SEQ ID NO: 83318 - DNA, 201 bp, Homo sapiens; identical to SEQ ID NO: 62417

SEQ ID NO: 83319 - DNA, 201 bp, Homo sapiens; identical to SEQ ID NO: 62306

SEQ ID NO: 83320 - DNA, 201 bp, Homo sapiens; identical to SEQ ID NO: 62419

SEQ ID NO: 83321 - DNA, 201 bp, Homo sapiens; identical to SEQ ID NO: 62311

SEQ ID NO: 83322 - DNA, 201 bp, Homo sapiens; identical to SEQ ID NO: 62422

SEQ ID NO: 83323 - DNA, 201 bp, Homo sapiens
ctcggggggcagaggttgtggtgagccgagatcatgccattgcactccagcctgggcaatgagagcgaaactgcatctcaaaaaaaaaagaaaaaaattgrtaacatggcactttccctctccagctgtgaactctttgagggttgggaatgtctttacctgtattcttggcacatagtatatggacttatgtttgtgaaa

SEQ ID NO: 83324 - DNA, 201 bp, Homo sapiens
tttttttttgagatggagtcttgctctgctgcccaggttggagtgcagtgccatgatcctggctcactgcaacttccaccttagcgattctcctgcctcarcctcccaagtagccgggattacaggcacatgccaccatgtcccggcaaagcctgctttctacaaaaaatatgcttgagcccaggaagcggaggttgcagt

SEQ ID NO: 83325 - DNA, 201 bp, Homo sapiens
ccctgcgacagtgacagcaggtgagcagtggatgtgcggtggttggaatcttggaagtgggtgtcacagttctcgcagtactggagggagggagtaggagmcctgcagagaaagaagaaaaagcattaagggcaggggaaggaaaaggggaagagttgaggcctcagagggggctggcagggtagaataggatcttttcag

SEQ ID NO: 83326 - DNA, 201 bp, Homo sapiens; identical to SEQ ID NO: 62199

SEQ ID NO: 83327 - DNA, 201 bp, Homo sapiens; identical to SEQ ID NO: 62200

SEQ ID NO: 83328 - DNA, 201 bp, Homo sapiens; identical to SEQ ID NO: 62329

SEQ ID NO: 83329 - DNA, 201 bp, Homo sapiens; identical to SEQ ID NO: 62205

SEQ ID NO: 83330 - DNA, 201 bp, Homo sapiens
gtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgag

SEQ ID NO: 83331 - DNA, 201 bp, Homo sapiens; identical to SEQ ID NO: 62330

SEQ ID NO: 83332 - DNA, 201 bp, Homo sapiens; identical to SEQ ID NO: 62332

SEQ ID NO: 83333 - DNA, 201 bp, Homo sapiens; identical to SEQ ID NO: 62333

SEQ ID NO: 83334 - DNA, 201 bp, Homo sapiens; identical to SEQ ID NO: 62336

SEQ ID NO: 83335 - DNA, 201 bp, Homo sapiens
agcaaatggagtccgagtggacagaaagacaagaccctgaccgtggggaatttaaaggccggccagcgtgcttccgaaggccgggggtggaggcattacckcctctccgtgccctcttctcttaacctgccctgggccaagggcctcggccccgcgaaactgcgagtcctccagaaagacacatcgctgttggggtgtcca

SEQ ID NO: 83336 - DNA, 201 bp, Homo sapiens
ctcccatttcaacattccccctggatcctctaccacctaaactcccagctggacggtgtcagtaagaacagagtggcagtaactctcactttgtagtggtwtatttaggatttgatgtgacacagttatttattgctgagtgagcaaacccctagcccccaagtggggactacaggcttcagtgcttcccccacactgcct

SEQ ID NO: 83337 - DNA, 201 bp, Homo sapiens
acccgggaggtggagattgcagtgagccaagatcgcgccactgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctcgg

SEQ ID NO: 83338 - DNA, 201 bp, Homo sapiens
ttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctataagattgatgatttgccaattttacagatgaaaaaacagacat

SEQ ID NO: 83339 - DNA, 201 bp, Homo sapiens
gggttggtggtgttttgtttgtttggagacagagtctctgtcgcccaagctggagtgcagtggcacaatcagggctcattgcagcctcgacatcccaggcycaagcaatcctccctcctcagcctccctagtagctgggactacaggcgtgtgccaccacatcggctaatttttgtattttttgtagagacagagttttgc

SEQ ID NO: 83340 - DNA, 201 bp, Homo sapiens
caccatgtcccggcaaagcctgctttctacaaaaaatatgcttgagcccaggaagcggaggttgcagtgagctgaaatcacaccattgcacaccagcctgrgcgacagagtgagatgagtgagactttgtctcaaaaaaaaaaaaaaaaaaaaaagggacaaattgccttccttcctacttaacagtgagggatccaggct

SEQ ID NO: 83341 - DNA, 201 bp, Homo sapiens; identical to SEQ ID NO: 62222

SEQ ID NO: 83342 - DNA, 201 bp, Homo sapiens; identical to SEQ ID NO: 62360

SEQ ID NO: 83343 - DNA, 201 bp, Homo sapiens
taccagcgctttctcctctacagtgagtagggatacaaggcaggaagggttggagggaaacaagggagggcaggagaactcctcactctgggtcctatgayaccctcccaggaagagctaggtgcttccaggggttttgactggcctgaccccaccttgcccttccagatcgctcaccacatcctcccgaaaagtgtgtgg

SEQ ID NO: 83344 - DNA, 201 bp, Homo sapiens
attgcagcctcgacatcccaggctcaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattac

SEQ ID NO: 83345 - DNA, 201 bp, Homo sapiens
ctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgtt

SEQ ID NO: 83346 - DNA, 201 bp, Homo sapiens
tcaagtccctgacttcctgcctggactccaaagccttcttattgactcctaggaatcaaggtaaggggttaaaatctcataaaacaggattaggactcacmaagtcttctggtgttacagggtgaaagaggctcgtgtgatgtcaccagagggatgtggctaagagctgtgatgtcacctgagggaggcaggatgggttct

SEQ ID NO: 83347 - DNA, 201 bp, Homo sapiens; identical to SEQ ID NO: 62366

SEQ ID NO: 83348 - DNA, 201 bp, Homo sapiens
ttgttggagggagaagctggagacttccagctccagctcccactcaagataataaagataatttttcaatcctcatctcattctggggtttgtctccagaygtcattcccactcctcccatttcaacattccccctggatcctctaccacctaaactcccagctggacggtgtcagtaagaacagagtggcagtaactctc

SEQ ID NO: 83349 - DNA, 201 bp, Homo sapiens
tgacaaggcctgggtcaccaccagagagtcctctctgcgtttccggatttccttcccagcaggcagcaccccaagtttcactcaccaaggccacaccccamggtgtcccagaaactggggaggcagtgctccatccaataaagcgggcaggaaggtggccccaggtcctaggtgctcctggatcgtgtagtctttaactgc

SEQ ID NO: 83350 - DNA, 201 bp, Homo sapiens
ccagccccccctcagcagcagtttgaagcccgggctggagatgggcaccccaagtggaaggttgggaggctgaggaccctgcgacagtgacagcaggtgarcagtggatgtgcggtggttggaatcttggaagtgggtgtcacagttctcgcagtactggagggagggagtaggagacctgcagagaaagaagaaaaagca

SEQ ID NO: 83351 - DNA, 201 bp, Homo sapiens; identical to SEQ ID NO: 62370

SEQ ID NO: 83352 - DNA, 201 bp, Homo sapiens; identical to SEQ ID NO: 62371

SEQ ID NO: 83353 - DNA, 201 bp, Homo sapiens
ggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattct

SEQ ID NO: 83354 - DNA, 201 bp, Homo sapiens; identical to SEQ ID NO: 62375

SEQ ID NO: 83355 - DNA, 201 bp, Homo sapiens
tgaatgagacaggccagggttaccagcgctttctcctctacagtgagtagggatacaaggcaggaagggttggagggaaacaagggagggcaggagaactmctcactctgggtcctatgacaccctcccaggaagagctaggtgcttccaggggttttgactggcctgaccccaccttgcccttccagatcgctcaccaca

SEQ ID NO: 83356 - DNA, 201 bp, Homo sapiens; identical to SEQ ID NO: 62377

SEQ ID NO: 83357 - DNA, 201 bp, Homo sapiens
acaggactccagatcgagcacttgtactttactgccccaataaaaagctgttaacattttagcttatttttttgagagagggtctcgctttgtcgcccagsctggagtgcagtggcgcaatcacaactcactgtagcctctgcctcccgagcccaaccgatcttcccacctcagcctccctagtagggaccacagatgcac

SEQ ID NO: 83358 - DNA, 201 bp, Homo sapiens
tcccaaagtgctgggattataggtgtgagctactgtgcctaaccacattttagctttttattacaaaaattttcggccgggcgcagtgactcacacttggraggatgaggcgggtggatcacgaggtcaggagttcaagaccagcctggccaaaatggtgaaaccccatctctactaaaaatacaaaaattagcctggcgt

SEQ ID NO: 83359 - DNA, 201 bp, Homo sapiens
ctggcgtggtggcgggcgcctgtaatcccagctacttgggaggctgaggcagagaattgctttgaacccgggaggtggagattgcagtgagccaagatcgygccactgcactccagcttgggcaacagaacgagactcccatctcaaaaaaaaaaaaaaaaaaattcaaacattacaccaaaatagaacagtattaataaa

SEQ ID NO: 83360 - DNA, 201 bp, Homo sapiens
gtggtggcgggcgcctgtaatcccagctacttgggaggctgaggcagagaattgctttgaacccgggaggtggagattgcagtgagccaagatcgcgccamtgcactccagcttgggcaacagaacgagactcccatctcaaaaaaaaaaaaaaaaaaattcaaacattacaccaaaatagaacagtattaataaactcta

SEQ ID NO: 83361 - DNA, 201 bp, Homo sapiens
cactattctagcattttacatatattaacccattgaatcctaacaacaattcttactacccccatttctaagatgagaaaactggaacatgtagacattargttgtttgcccaagtaagtggaatcaggctttaaatccagggagctcatgtttataaccacttgactatactaccctgtcaacctacacatgaggataag

SEQ ID NO: 83362 - DNA, 201 bp, Homo sapiens
attcaaacattacaccaaaatagaacagtattaataaactctaatatactggtcacccaaattttgtttgttttttaactaaatcgcaagcctcagccctyggcaaattttttgtggcagtccatgggatataaatttatcaagctaggtgtggtggctcatgcctgtaatcccaacactttaggaggctaaggtgggccg

SEQ ID NO: 83363 - DNA, 201 bp, Homo sapiens
tttttttttttttgagatggagtcttgctctgctgcccaggttggagtgcagtgccatgatcctggctcactgcaacttccaccttagcgattctcctgcvtcagcctcccaagtagccgggattacaggcacatgccaccatgtcccggcaaagcctgctttctacaaaaaatatgcttgagcccaggaagcggaggttg

SEQ ID NO: 83364 - DNA, 201 bp, Homo sapiens; identical to SEQ ID NO: 62255

SEQ ID NO: 83365 - DNA, 201 bp, Homo sapiens
tcctcccatttcaacattccccctggatcctctaccacctaaactcccagctggacggtgtcagtaagaacagagtggcagtaactctcactttgtagtgktatatttaggatttgatgtgacacagttatttattgctgagtgagcaaacccctagcccccaagtggggactacaggcttcagtgcttcccccacactgc

SEQ ID NO: 83366 - DNA, 201 bp, Homo sapiens
ctttgcaaacattactattaattatagcaaatatatactttggacttaccatgtgcaagtctttgctaagggctttatgtgcattatttcatttaatcctrtaagattgatgatttgccaattttacagatgaaaaaacagacatagcagttaggggttggtggtgttttgtttgtttggagacagagtctctgtcgccca

SEQ ID NO: 83367 - DNA, 201 bp, Homo sapiens
gatcccgctcccaagccctgtctttctcctccctccttctctcctccctccagctcagtgtggccacccgagggggtctctccctcccagccacagctcgkgtatcccaagctgggaaatgtgtcactcggggctggggtgctgatctgtagcctagtccttcctggtccctcttgaggacagtggggatgggattggcac

SEQ ID NO: 83368 - DNA, 201 bp, Homo sapiens
cagcccgtctctcacgaagacagagcctattgaccaaaaacttcaggatctgcatctgagcagatcccaggaaggggaagtcaaagggcccaggtcagagrcccaagttcagacttcagcagcagactagggtcagactttaccaaagtcagaactcgaggttcatgtaagtccttagatcccgctcccaagccctgtctt

SEQ ID NO: 83369 - DNA, 201 bp, Homo sapiens
attagtcataatgactatagctaacattcatgtattgcatactatgcggcatgcactattctagcattttacatatattaacccattgaatcctaacaacrattcttactacccccatttctaagatgagaaaactggaacatgtagacattaggttgtttgcccaagtaagtggaatcaggctttaaatccagggagctc

SEQ ID NO: 83370 - DNA, 201 bp, Homo sapiens; identical to SEQ ID NO: 62399

SEQ ID NO: 83371 - DNA, 201 bp, Homo sapiens; identical to SEQ ID NO: 62397

SEQ ID NO: 83372 - DNA, 201 bp, Homo sapiens; identical to SEQ ID NO: 62400

SEQ ID NO: 83373 - DNA, 201 bp, Homo sapiens; identical to SEQ ID NO: 62401

SEQ ID NO: 83374 - DNA, 201 bp, Homo sapiens; identical to SEQ ID NO: 62402

SEQ ID NO: 83375 - DNA, 201 bp, Homo sapiens; identical to SEQ ID NO: 62403

SEQ ID NO: 83376 - DNA, 201 bp, Homo sapiens
ctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacacccta

SEQ ID NO: 83377 - DNA, 201 bp, Homo sapiens
tctgtgcgcgccggaccgccaaaccgagattagcaaggaccaggaccttaatataaacccagctccccattttcccgggtttctcatgcttccctaaactyggtcgccccctacagccccctgcccctgggttcttttccacatcccccaccactcctccatttcgcatccaagacttcatgaaaggctttcccagaaaag

SEQ ID NO: 83378 - DNA, 201 bp, Homo sapiens
atataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgat

SEQ ID NO: 83379 - DNA, 201 bp, Homo sapiens
  misc_feature (1)...(201): n = A,T,C or G, or insertion/deletion polymorphism (see Tables 1-2)
gtgcctaccacccggcatgagcaagacaagggggtgggtggtgggagagtggggaagtgtgggaaagaaaagtgtagacaaatgggtggaacaaagaagtntaaagtttagatttgggggctagagttctggtcccagttcaactaagtgtacaagcttgataatcgtgggccttcctatcacactggcctcttccagcaa

SEQ ID NO: 83380 - DNA, 201 bp, Homo sapiens
cctcttccagcaaaaccctacccattctcatctctagaggccttgacttcccttatcaccctgcattataatatttgataacatgggccgggagtggtggytcatgcctgcaaccccagcactttgggaagccgaggccggcggatcacctgaggtcgggagttcaagaccagcttggccaacatggagaaaccccgtctc

SEQ ID NO: 83381 - DNA, 201 bp, Homo sapiens
gagggggtctctccctcccagccacagctcgggtatcccaagctgggaaatgtgtcactcggggctggggtgctgatctgtagcctagtccttcctggtcyctcttgaggacagtggggatgggattggcacggccctcaccccggggtcccagccccattcctggctcccagccccccctcagcagcagtttgaagcccg

SEQ ID NO: 83382 - DNA, 201 bp, Homo sapiens
aaaagtgaataaaccacaaatggttgatttatttctgactctcagcccgtctctcacgaagacagagcctattgaccaaaaacttcaggatctgcatctgrgcagatcccaggaaggggaagtcaaagggcccaggtcagaggcccaagttcagacttcagcagcagactagggtcagactttaccaaagtcagaactcga

SEQ ID NO: 83383 - DNA, 201 bp, Homo sapiens
ggacttatgtttgtgaaatcagtgaattggctgtagtcagggaactcctcctgggggaagtgagacttgcacgaagctgggcaattcttggtccagggggsttgaaagaataggtgggggactcccaggagggtctgggacctgaaagtgaacccagattggcagggaggtgaccttatcatgccacctggagaggctgcc

SEQ ID NO: 83384 - DNA, 201 bp, Homo sapiens
agggttgggaatgtctttacctgtattcttggcacatagtatatggacttatgtttgtgaaatcagtgaattggctgtagtcagggaactcctcctggggkaagtgagacttgcacgaagctgggcaattcttggtccaggggggttgaaagaataggtgggggactcccaggagggtctgggacctgaaagtgaacccag

SEQ ID NO: 83385 - DNA, 201 bp, Homo sapiens
gtagacaaatgggtggaacaaagaagtttaaagtttagatttgggggctagagttctggtcccagttcaactaagtgtacaagcttgataatcgtgggccytcctatcacactggcctcttccagcaaaaccctacccattctcatctctagaggccttgacttcccttatcaccctgcattataatatttgataacatgg

SEQ ID NO: 83386 - DNA, 201 bp, Homo sapiens
tgagtgctagagataggctggtcccacttgagggaatccattcttttgctccctagctgctcaacttggggctcctccttgcttggttcggaagcagcccyagaaaccctcaatgcccccgagtccttagtcttgggatgccccacatcttccatggtttctggggcactatcccagtcacttcctgaattctccgaggag

SEQ ID NO: 83387 - DNA, 201 bp, Homo sapiens
tcaccacatcctcccgaaaagtgtgtggaggaattcaagtccctgacttcctgcctggactccaaagccttcttattgactcctaggaatcaaggtaaggkgttaaaatctcataaaacaggattaggactcaccaagtcttctggtgttacagggtgaaagaggctcgtgtgatgtcaccagagggatgtggctaagagc

SEQ ID NO: 83388 - DNA, 201 bp, Homo sapiens
cccagaaactggggaggcagtgctccatccaataaagcgggcaggaaggtggccccaggtcctaggtgctcctggatcgtgtagtctttaactgctgcccyaagggacctcaaggaataggaattctctttgttaggaggtggaatgaaagtgtccagcaaactccagccagcagcgttcgtcccttgatttagagggcta

SEQ ID NO: 83389 - DNA, 201 bp, Homo sapiens; identical to SEQ ID NO: 62291

SEQ ID NO: 83390 - DNA, 201 bp, Homo sapiens; identical to SEQ ID NO: 62293

SEQ ID NO: 83391 - DNA, 201 bp, Homo sapiens; identical to SEQ ID NO: 62415

SEQ ID NO: 83392 - DNA, 201 bp, Homo sapiens; identical to SEQ ID NO: 62300

SEQ ID NO: 83393 - DNA, 201 bp, Homo sapiens; identical to SEQ ID NO: 62304

SEQ ID NO: 83394 - DNA, 201 bp, Homo sapiens; identical to SEQ ID NO: 62416

SEQ ID NO: 83395 - DNA, 201 bp, Homo sapiens
tggtgccacctgaatccacatgatcccatctgagtttgggactggcccctccagcctccagtctcccagactcttgagtgctagagataggctggtcccasttgagggaatccattcttttgctccctagctgctcaacttggggctcctccttgcttggttcggaagcagccctagaaaccctcaatgcccccgagtcct

SEQ ID NO: 83396 - DNA, 201 bp, Homo sapiens
gaatcccttgaactcggggggcagaggttgtggtgagccgagatcatgccattgcactccagcctgggcaatgagagcgaaactgcatctcaaaaaaaaargaaaaaaattgataacatggcactttccctctccagctgtgaactctttgagggttgggaatgtctttacctgtattcttggcacatagtatatggactt

SEQ ID NO: 83397 - DNA, 201 bp, Homo sapiens; identical to SEQ ID NO: 64497

SEQ ID NO: 83398 - DNA, 201 bp, Homo sapiens; identical to SEQ ID NO: 64498

SEQ ID NO: 83399 - DNA, 201 bp, Homo sapiens; identical to SEQ ID NO: 64500

SEQ ID NO: 83400 - DNA, 201 bp, Homo sapiens; identical to SEQ ID NO: 64501

SEQ ID NO: 83401 - DNA, 201 bp, Homo sapiens; identical to SEQ ID NO: 64502

SEQ ID NO: 83402 - DNA, 201 bp, Homo sapiens
caaagcagcaaggaccacatgaatggtagatgtaggcagcatgagtggttaagagtcaagggagtagccggggtagtggcttacacctgtaatcccaacastttgggaggctgaggcaggtggatcacttgaggtcaggagttcgagaccagcctggccaacatggtgaaaccctgtctctactaaagatacaaaaagtta

SEQ ID NO: 83403 - DNA, 201 bp, Homo sapiens; identical to SEQ ID NO: 64503

SEQ ID NO: 83404 - DNA, 201 bp, Homo sapiens; identical to SEQ ID NO: 64504

SEQ ID NO: 83405 - DNA, 201 bp, Homo sapiens; identical to SEQ ID NO: 64506

SEQ ID NO: 83406 - DNA, 201 bp, Homo sapiens; identical to SEQ ID NO: 64508

SEQ ID NO: 83407 - DNA, 201 bp, Homo sapiens; identical to SEQ ID NO: 64511

SEQ ID NO: 83408 - DNA, 201 bp, Homo sapiens; identical to SEQ ID NO: 64512

SEQ ID NO: 83409 - DNA, 201 bp, Homo sapiens; identical to SEQ ID NO: 64518

SEQ ID NO: 83410 - DNA, 201 bp, Homo sapiens
aggcccagggagggaaggtagcttgcaggaagccagtcagcagagctgaaatgagaacacagatctccaggtttccaatgtggtttgcattcttctatacyctcaaggtaggtgctggaggaagagctgatcccgtctctgaggtcaagggccggactaggacaaggactggaatcttgagggatggatgtctgggttccc

SEQ ID NO: 83411 - DNA, 201 bp, Homo sapiens; identical to SEQ ID NO: 64534

SEQ ID NO: 83412 - DNA, 201 bp, Homo sapiens; identical to SEQ ID NO: 64537

SEQ ID NO: 83413 - DNA, 201 bp, Homo sapiens; identical to SEQ ID NO: 64539

SEQ ID NO: 83414 - DNA, 201 bp, Homo sapiens; identical to SEQ ID NO: 64541

SEQ ID NO: 83415 - DNA, 201 bp, Homo sapiens; identical to SEQ ID NO: 64542

SEQ ID NO: 83416 - DNA, 201 bp, Homo sapiens
gggaatgcgatcctaaaggcttgggacttctggggaagtggcggcttttagcccctgcgggagccgagccgggccgggggaggagggatggtgctgtttcwgggatgagtgcgagttgggggccgagggaacacggatgtggggtgcagaacgctgtagtggggacctccaggccggcttttgcttgcaccggagggaaga

SEQ ID NO: 83417 - DNA, 201 bp, Homo sapiens; identical to SEQ ID NO: 64546

SEQ ID NO: 83418 - DNA, 201 bp, Homo sapiens
ggtcctgggcgtccgggcccccaatattcacgcactcgcaccacgcactcatattccctcaccccaccatcacggccccaaagaaggtcttccctctcgcraagtccaccatatcggggtgactgatgttgacgtacaccctctcgcccctccggagctgcaccaggccgccgaaccccacgctcgtgtaccagagaggcc

SEQ ID NO: 83419 - DNA, 201 bp, Homo sapiens; identical to SEQ ID NO: 64549

SEQ ID NO: 83420 - DNA, 201 bp, Homo sapiens; identical to SEQ ID NO: 64550

SEQ ID NO: 83421 - DNA, 201 bp, Homo sapiens; identical to SEQ ID NO: 64551

SEQ ID NO: 83422 - DNA, 201 bp, Homo sapiens; identical to SEQ ID NO: 64552

SEQ ID NO: 83423 - DNA, 201 bp, Homo sapiens; identical to SEQ ID NO: 64555

SEQ ID NO: 83424 - DNA, 201 bp, Homo sapiens; identical to SEQ ID NO: 64557

SEQ ID NO: 83425 - DNA, 201 bp, Homo sapiens; identical to SEQ ID NO: 64562

SEQ ID NO: 83426 - DNA, 201 bp, Homo sapiens; identical to SEQ ID NO: 64564

SEQ ID NO: 83427 - DNA, 201 bp, Homo sapiens; identical to SEQ ID NO: 64565

SEQ ID NO: 83428 - DNA, 201 bp, Homo sapiens; identical to SEQ ID NO: 64566

SEQ ID NO: 83429 - DNA, 201 bp, Homo sapiens; identical to SEQ ID NO: 64567

SEQ ID NO: 83430 - DNA, 201 bp, Homo sapiens; identical to SEQ ID NO: 64568

SEQ ID NO: 83431 - DNA, 201 bp, Homo sapiens
gcggccctgggggtccccgccgccagggggcgcccggccccggtagccgacgagacagtagaggtaatagaggccgtcctgcgggagcgccagcccctcgkcgtccgagaactgcgtcccgctcgtcagaaacgcctgttccttcgtcgtctcccagcctagcccctgccccttcagcggagcgcctgcggagacacgggc

SEQ ID NO: 83432 - DNA, 201 bp, Homo sapiens; identical to SEQ ID NO: 64569

SEQ ID NO: 83433 - DNA, 201 bp, Homo sapiens; identical to SEQ ID NO: 64571

SEQ ID NO: 83434 - DNA, 201 bp, Homo sapiens; identical to SEQ ID NO: 64570

SEQ ID NO: 83435 - DNA, 201 bp, Homo sapiens; identical to SEQ ID NO: 64574

SEQ ID NO: 83436 - DNA, 201 bp, Homo sapiens; identical to SEQ ID NO: 64578

SEQ ID NO: 83437 - DNA, 201 bp, Homo sapiens; identical to SEQ ID NO: 64582

SEQ ID NO: 83438 - DNA, 201 bp, Homo sapiens; identical to SEQ ID NO: 64580

SEQ ID NO: 83439 - DNA, 201 bp, Homo sapiens; identical to SEQ ID NO: 64587

SEQ ID NO: 83440 - DNA, 201 bp, Homo sapiens; identical to SEQ ID NO: 64588

SEQ ID NO: 83441 - DNA, 201 bp, Homo sapiens; identical to SEQ ID NO: 64589

SEQ ID NO: 83442 - DNA, 201 bp, Homo sapiens; identical to SEQ ID NO: 13091

SEQ ID NO: 83443 - DNA, 201 bp, Homo sapiens; identical to SEQ ID NO: 13092

SEQ ID NO: 83444 - DNA, 201 bp, Homo sapiens; identical to SEQ ID NO: 13095

SEQ ID NO: 83445 - DNA, 201 bp, Homo sapiens; identical to SEQ ID NO: 13096

SEQ ID NO: 83446 - DNA, 201 bp, Homo sapiens; identical to SEQ ID NO: 64595

SEQ ID NO: 83447 - DNA, 201 bp, Homo sapiens; identical to SEQ ID NO: 64596

SEQ ID NO: 83448 - DNA, 201 bp, Homo sapiens; identical to SEQ ID NO: 64597

SEQ ID NO: 83449 - DNA, 201 bp, Homo sapiens
gagtcaccgtctcggcgccctcgagcagcagctcgggagtgcccggcccgtaggcgccccccgcccggtacagagagctgcgcagcgtgaccgagcggccytgggggtccccgccgccagggggcgcccggccccggtagccgacgagacagtagaggtaatagaggccgtcctgcgggagcgccagcccctcggcgtccg

SEQ ID NO: 83450 - DNA, 201 bp, Homo sapiens
aagctttccattctttattttcatcaggttcaaaatcaatttccaaacagtctcctacatttttcccactgccatggggtcctgggcgtccgggcccccartattcacgcactcgcaccacgcactcatattccctcaccccaccatcacggccccaaagaaggtcttccctctcgcgaagtccaccatatcggggtgact

SEQ ID NO: 83451 - DNA, 201 bp, Homo sapiens; identical to SEQ ID NO: 64598

SEQ ID NO: 83452 - DNA, 201 bp, Homo sapiens
gctcagcagagagagaaactgaggcccagggagggaaggtagcttgcaggaagccagtcagcagagctgaaatgagaacacagatctccaggtttccaatrtggtttgcattcttctataccctcaaggtaggtgctggaggaagagctgatcccgtctctgaggtcaagggccggactaggacaaggactggaatcttga

SEQ ID NO: 83453 - DNA, 201 bp, Homo sapiens; identical to SEQ ID NO: 64599

SEQ ID NO: 83454 - DNA, 201 bp, Homo sapiens
gcctgggttctctgaactggggaagaagttgaggttagggagacaggctctcagggtggaaccaaaggggtctttagacatcttctggctcagcagagagrgaaactgaggcccagggagggaaggtagcttgcaggaagccagtcagcagagctgaaatgagaacacagatctccaggtttccaatgtggtttgcattct

SEQ ID NO: 83455 - DNA, 201 bp, Homo sapiens; identical to SEQ ID NO: 64600
  misc_feature (1)...(201): n = A,T,C or G, or insertion/deletion polymorphism (see Tables 1-2)

SEQ ID NO: 83456 - DNA, 201 bp, Homo sapiens
ggagccgaaggactctgggcgagcagaactggaaccttcggattatttacactcttattcaggtcttggaggtccttacctatgaggtgggcagctgggarcccggggctgagatctgtttctggctcctcctctggcagcttctgaaaccctggaaggggcaaagagtccacgattgggggcagggcagccacccatgca

SEQ ID NO: 83457 - DNA, 201 bp, Homo sapiens
caggctacccttgagagaacagggcgcagggatggggagcctggattcctagaggaagaggtatctggggacgcagcagggagctgggagcccctgagggkctgaagcggggaaggagagacagtctgctcttacccagtccttgctgggcctgtgccccggggtcggccgtctccgttacctggttgggtggggtcacag

SEQ ID NO: 83458 - DNA, 201 bp, Homo sapiens
aggcaggagaatcacttaaacctgggaggcagaggttgcagtgagccaagattgcaccattgcactccagcctgggcaacaggctgagactctctctctcaaaaaaaaaaaaaaaaaaaaaaaaagagtcaagggaagaaagaccaggtccaaggaagctggaagtggctccaatcatctccccttcttggtaacatctct

SEQ ID NO: 83459 - DNA, 201 bp, Homo sapiens; identical to SEQ ID NO: 64607

SEQ ID NO: 83460 - DNA, 201 bp, Homo sapiens; identical to SEQ ID NO: 64608

SEQ ID NO: 83461 - DNA, 201 bp, Homo sapiens; identical to SEQ ID NO: 64610

SEQ ID NO: 83462 - DNA, 201 bp, Homo sapiens; identical to SEQ ID NO: 64499

SEQ ID NO: 83463 - DNA, 201 bp, Homo sapiens; identical to SEQ ID NO: 64505

SEQ ID NO: 83464 - DNA, 201 bp, Homo sapiens; identical to SEQ ID NO: 64507

SEQ ID NO: 83465 - DNA, 201 bp, Homo sapiens; identical to SEQ ID NO: 64509

SEQ ID NO: 83466 - DNA, 201 bp, Homo sapiens; identical to SEQ ID NO: 64513

SEQ ID NO: 83467 - DNA, 201 bp, Homo sapiens; identical to SEQ ID NO: 64514

SEQ ID NO: 83468 - DNA, 201 bp, Homo sapiens; identical to SEQ ID NO: 64515

SEQ ID NO: 83469 - DNA, 201 bp, Homo sapiens; identical to SEQ ID NO: 64519

SEQ ID NO: 83470 - DNA, 201 bp, Homo sapiens; identical to SEQ ID NO: 64520

SEQ ID NO: 83471 - DNA, 201 bp, Homo sapiens; identical to SEQ ID NO: 64521

SEQ ID NO: 83472 - DNA, 201 bp, Homo sapiens; identical to SEQ ID NO: 64522

SEQ ID NO: 83473 - DNA, 201 bp, Homo sapiens; identical to SEQ ID NO: 64523

SEQ ID NO: 83474 - DNA, 201 bp, Homo sapiens; identical to SEQ ID NO: 64524

SEQ ID NO: 83475 - DNA, 201 bp, Homo sapiens; identical to SEQ ID NO: 64525

SEQ ID NO: 83476 - DNA, 201 bp, Homo sapiens; identical to SEQ ID NO: 64526

SEQ ID NO: 83477 - DNA, 201 bp, Homo sapiens; identical to SEQ ID NO: 64527

SEQ ID NO: 83478 - DNA, 201 bp, Homo sapiens; identical to SEQ ID NO: 64528

SEQ ID NO: 83479 - DNA, 201 bp, Homo sapiens; identical to SEQ ID NO: 64529

SEQ ID NO: 83480 - DNA, 201 bp, Homo sapiens; identical to SEQ ID NO: 64530

SEQ ID NO: 83481 - DNA, 201 bp, Homo sapiens; identical to SEQ ID NO: 64531

SEQ ID NO: 83482 - DNA, 201 bp, Homo sapiens; identical to SEQ ID NO: 64532

SEQ ID NO: 83483 - DNA, 201 bp, Homo sapiens; identical to SEQ ID NO: 64533

SEQ ID NO: 83484 - DNA, 201 bp, Homo sapiens; identical to SEQ ID NO: 64535

SEQ ID NO: 83485 - DNA, 201 bp, Homo sapiens; identical to SEQ ID NO: 64536

SEQ ID NO: 83486 - DNA, 201 bp, Homo sapiens; identical to SEQ ID NO: 64538

SEQ ID NO: 83487 - DNA, 201 bp, Homo sapiens; identical to SEQ ID NO: 64540

SEQ ID NO: 83488 - DNA, 201 bp, Homo sapiens; identical to SEQ ID NO: 64543

SEQ ID NO: 83489 - DNA, 201 bp, Homo sapiens; identical to SEQ ID NO: 64545

SEQ ID NO: 83490 - DNA, 201 bp, Homo sapiens
actgagaatatttaacccgcacccgtgcacccaccctgaattaagacgtgtgtcgcaactcagcatctttatcggcagcactgaagctttccattctttaytttcatcaggttcaaaatcaatttccaaacagtctcctacatttttcccactgccatggggtcctgggcgtccgggcccccaatattcacgcactcgcac

SEQ ID NO: 83491 - DNA, 201 bp, Homo sapiens; identical to SEQ ID NO: 64547

SEQ ID NO: 83492 - DNA, 201 bp, Homo sapiens; identical to SEQ ID NO: 64548

SEQ ID NO: 83493 - DNA, 201 bp, Homo sapiens
gaggcaggagaatcacttaaacctgggaggcagaggttgcagtgagccaagattgcaccattgcactccagcctgggcaacaggctgagactctctctctmaaaaaaaaaaaaaaaaaaaaaaaaagagtcaagggaagaaagaccaggtccaaggaagctggaagtggctccaatcatctccccttcttggtaacatctc

SEQ ID NO: 83494 - DNA, 201 bp, Homo sapiens
tgaggcaggagaatcacttaaacctgggaggcagaggttgcagtgagccaagattgcaccattgcactccagcctgggcaacaggctgagactctctctcwcaaaaaaaaaaaaaaaaaaaaaaaaagagtcaagggaagaaagaccaggtccaaggaagctggaagtggctccaatcatctccccttcttggtaacatct

SEQ ID NO: 83495 - DNA, 201 bp, Homo sapiens; identical to SEQ ID NO: 64553

SEQ ID NO: 83496 - DNA, 201 bp, Homo sapiens; identical to SEQ ID NO: 64554

SEQ ID NO: 83497 - DNA, 201 bp, Homo sapiens; identical to SEQ ID NO: 64558

SEQ ID NO: 83498 - DNA, 201 bp, Homo sapiens; identical to SEQ ID NO: 64559

SEQ ID NO: 83499 - DNA, 201 bp, Homo sapiens
tagagaagcttcggagtttgagaagtcccccttcctcccaccctccaactgggctaatggtggggcctggccattcagaggcagggagggggtgggacagrcagaccatcatccctaggagcaaaggccatacactgtgttgtgatgaattgtttcaagcaaccagaagagtactgagaatatttaacccgcacccgtgca

SEQ ID NO: 83500 - DNA, 201 bp, Homo sapiens
ccattcagaggcagggagggggtgggacaggcagaccatcatccctaggagcaaaggccatacactgtgttgtgatgaattgtttcaagcaaccagaagastactgagaatatttaacccgcacccgtgcacccaccctgaattaagacgtgtgtcgcaactcagcatctttatcggcagcactgaagctttccattcttt

SEQ ID NO: 83501 - DNA, 201 bp, Homo sapiens
cggccccggtagccgacgagacagtagaggtaatagaggccgtcctgcgggagcgccagcccctcggcgtccgagaactgcgtcccgctcgtcagaaacgsctgttccttcgtcgtctcccagcctagcccctgccccttcagcggagcgcctgcggagacacgggccgacgcgctcttgggaatgcgatcctaaaggctt

SEQ ID NO: 83502 - DNA, 201 bp, Homo sapiens; identical to SEQ ID NO: 64560

SEQ ID NO: 83503 - DNA, 201 bp, Homo sapiens
gggacgagcgtaagagtgggcacgagcgacaaaaggtcgtgaagcgggtgggaaaccgagcactggaatcatggagccgaaggactctgggcgagcagaamtggaaccttcggattatttacactcttattcaggtcttggaggtccttacctatgaggtgggcagctgggagcccggggctgagatctgtttctggctcc

SEQ ID NO: 83504 - DNA, 201 bp, Homo sapiens
aaggactctgggcgagcagaactggaaccttcggattatttacactcttattcaggtcttggaggtccttacctatgaggtgggcagctgggagcccgggsctgagatctgtttctggctcctcctctggcagcttctgaaaccctggaaggggcaaagagtccacgattgggggcagggcagccacccatgcaggctacc

SEQ ID NO: 83505 - DNA, 201 bp, Homo sapiens
actcttattcaggtcttggaggtccttacctatgaggtgggcagctgggagcccggggctgagatctgtttctggctcctcctctggcagcttctgaaacyctggaaggggcaaagagtccacgattgggggcagggcagccacccatgcaggctacccttgagagaacagggcgcagggatggggagcctggattcctag

SEQ ID NO: 83506 - DNA, 201 bp, Homo sapiens; identical to SEQ ID NO: 64561

SEQ ID NO: 83507 - DNA, 201 bp, Homo sapiens; identical to SEQ ID NO: 64563

SEQ ID NO: 83508 - DNA, 201 bp, Homo sapiens
ggaaggagagacagtctgctcttacccagtccttgctgggcctgtgccccggggtcggccgtctccgttacctggttgggtggggtcacagtgcccagagytcagattcagctcatgtcacccctacccctctgaaagtggacccaagctgcaggcctggggtttctcctaccagcaccatccccaacacacacctcctta

SEQ ID NO: 83509 - DNA, 201 bp, Homo sapiens
cagtctgctcttacccagtccttgctgggcctgtgccccggggtcggccgtctccgttacctggttgggtggggtcacagtgcccagagttcagattcagytcatgtcacccctacccctctgaaagtggacccaagctgcaggcctggggtttctcctaccagcaccatccccaacacacacctccttagaagggagaac

SEQ ID NO: 83510 - DNA, 201 bp, Homo sapiens
cccagtccttgctgggcctgtgccccggggtcggccgtctccgttacctggttgggtggggtcacagtgcccagagttcagattcagctcatgtcaccccwacccctctgaaagtggacccaagctgcaggcctggggtttctcctaccagcaccatccccaacacacacctccttagaagggagaacaagcaaggcatag

SEQ ID NO: 83511 - DNA, 201 bp, Homo sapiens; identical to SEQ ID NO: 64573

SEQ ID NO: 83512 - DNA, 201 bp, Homo sapiens
acagtgcccagagttcagattcagctcatgtcacccctacccctctgaaagtggacccaagctgcaggcctggggtttctcctaccagcaccatccccaayacacacctccttagaagggagaacaagcaaggcataggtacttgggcggagaaacagatgtacctcgggaagaggagaggagacacaaggggcttatgtc

SEQ ID NO: 83513 - DNA, 201 bp, Homo sapiens
ctcatgtcacccctacccctctgaaagtggacccaagctgcaggcctggggtttctcctaccagcaccatccccaacacacacctccttagaagggagaasaagcaaggcataggtacttgggcggagaaacagatgtacctcgggaagaggagaggagacacaaggggcttatgtcgggacacaagcacaacatcacagg

SEQ ID NO: 83514 - DNA, 201 bp, Homo sapiens; identical to SEQ ID NO: 64576

SEQ ID NO: 83515 - DNA, 201 bp, Homo sapiens
aagtggacccaagctgcaggcctggggtttctcctaccagcaccatccccaacacacacctccttagaagggagaacaagcaaggcataggtacttgggcrgagaaacagatgtacctcgggaagaggagaggagacacaaggggcttatgtcgggacacaagcacaacatcacaggaacatggaaagagagtcagcaaag

SEQ ID NO: 83516 - DNA, 201 bp, Homo sapiens
cagcaaagagacaagacatccccaccagggacagccgagccagctgagccagagggggcaaaagaccacaggcacaaccagagggagccaagcatccgcargatacaactctccaccagggcctgttgcagccactcaccagtcctccctgatcctggggcactaaggccagcacagccaggacagtgataggcaccgcca

SEQ ID NO: 83517 - DNA, 201 bp, Homo sapiens
aaagagacaagacatccccaccagggacagccgagccagctgagccagagggggcaaaagaccacaggcacaaccagagggagccaagcatccgcaagatwcaactctccaccagggcctgttgcagccactcaccagtcctccctgatcctggggcactaaggccagcacagccaggacagtgataggcaccgccagcaa

SEQ ID NO: 83518 - DNA, 201 bp, Homo sapiens
tggagcctcccacccctgccctccagccccagtgcccccattgagactgaaccagagccagagcagggggctttcatacctcagggacgggcccaccccckccctgtagacctgcacacctggctgggactttccgcacacccctgctcccctcacccagcttcctgtttacccagagctggggtggggcagctggatgcc

SEQ ID NO: 83519 - DNA, 201 bp, Homo sapiens
ccgtaatactaataataatatagctgacccacaaaatgcacttaacatgtttatgccactgatttacacactttaataatttttttttttgagacagggtytcgctatgtcacccagactggaatgcaatggcaggatcatggctcactgcagccttgacctcccaggatctatggattcacctacctcagcctcctgaat

SEQ ID NO: 83520 - DNA, 201 bp, Homo sapiens; identical to SEQ ID NO: 64601

SEQ ID NO: 83521 - DNA, 201 bp, Homo sapiens; identical to SEQ ID NO: 64603

SEQ ID NO: 83522 - DNA, 201 bp, Homo sapiens; identical to SEQ ID NO: 64604

SEQ ID NO: 83523 - DNA, 201 bp, Homo sapiens; identical to SEQ ID NO: 64605

SEQ ID NO: 83524 - DNA, 201 bp, Homo sapiens; identical to SEQ ID NO: 64606

SEQ ID NO: 83525 - DNA, 201 bp, Homo sapiens
aataatatagctgacccacaaaatgcacttaacatgtttatgccactgatttacacactttaataatttttttttttgagacagggtctcgctatgtcacscagactggaatgcaatggcaggatcatggctcactgcagccttgacctcccaggatctatggattcacctacctcagcctcctgaatagctgggactata

SEQ ID NO: 83526 - DNA, 201 bp, Homo sapiens; identical to SEQ ID NO: 64609

SEQ ID NO: 83527 - DNA, 201 bp, Homo sapiens
ctaatttttgcattttttgtagagatggatttttgccacattgcccaggctgggctcaaactcctggactcacgtgatctgcccgtgttggcctcctaaartgctgggattacaagcatgagccatcatgcccagccaataattataatcctgacaaaaaccctaagaggaaactgaggtacagagaggttaagaaactta

SEQ ID NO: 83528 - DNA, 201 bp, Homo sapiens; identical to SEQ ID NO: 64611

SEQ ID NO: 83529 - DNA, 201 bp, Homo sapiens
atttttgcattttttgtagagatggatttttgccacattgcccaggctgggctcaaactcctggactcacgtgatctgcccgtgttggcctcctaaagtgmtgggattacaagcatgagccatcatgcccagccaataattataatcctgacaaaaaccctaagaggaaactgaggtacagagaggttaagaaacttatgg

SEQ ID NO: 83530 - DNA, 201 bp, Homo sapiens; identical to SEQ ID NO: 64612

SEQ ID NO: 83531 - DNA, 201 bp, Homo sapiens; identical to SEQ ID NO: 64613

SEQ ID NO: 83532 - DNA, 201 bp, Homo sapiens
aggcctggctaggagtgcctgggatgggcgggacactgcctggggaaggcgggtggggagcggtggaacccgacccttggagcgaaggcggacaagtaggyaggcaaagatgctgagtagtccctccccaaagtcccctgggcacaagacagtctgatgaatctagaaaaccccatggatgactgggagggaaggaaacgg

SEQ ID NO: 83533 - DNA, 201 bp, Homo sapiens; identical to SEQ ID NO: 64615

SEQ ID NO: 83534 - DNA, 201 bp, Homo sapiens
tgcacattctgcacatgtatcccagaacttaaaataaaataaaataaaatttaaatttaaaaaagagccacactgggatcctgcaagagcacagccatctytttccccttcccaacttcccacaggctttccatcttattcaggagcaccaacccgaagtccaggagaaagaccctaagaccctagccagaaccatgtgta

SEQ ID NO: 83535 - DNA, 201 bp, Homo sapiens; identical to SEQ ID NO: 64616

SEQ ID NO: 83536 - DNA, 201 bp, Homo sapiens; identical to SEQ ID NO: 64617

SEQ ID NO: 83537 - DNA, 201 bp, Homo sapiens; identical to SEQ ID NO: 64618

SEQ ID NO: 83538 - DNA, 201 bp, Homo sapiens; identical to SEQ ID NO: 64619

SEQ ID NO: 83539 - DNA, 201 bp, Homo sapiens; identical to SEQ ID NO: 64620

SEQ ID NO: 83540 - DNA, 201 bp, Homo sapiens; identical to SEQ ID NO: 64621

SEQ ID NO: 83541 - DNA, 201 bp, Homo sapiens; identical to SEQ ID NO: 64622

SEQ ID NO: 83542 - DNA, 201 bp, Homo sapiens; identical to SEQ ID NO: 64624

SEQ ID NO: 83543 - DNA, 201 bp, Homo sapiens; identical to SEQ ID NO: 64631

SEQ ID NO: 83544 - DNA, 201 bp, Homo sapiens; identical to SEQ ID NO: 64737

SEQ ID NO: 83545 - DNA, 201 bp, Homo sapiens
cttgagtctaggagctcaagctcctatattgtccagcctggacaatataataataagatcctgtctatataaaatacttttttttcttttttgaggggggyttcgctctcgttgcacaggctggagtacaatggtgtgatctcagctcactgcaacctccgcctcctgggtttaagcaattctccttcctcagcctcccaa

SEQ ID NO: 83546 - DNA, 201 bp, Homo sapiens; identical to SEQ ID NO: 64743

SEQ ID NO: 83547 - DNA, 201 bp, Homo sapiens
gtttcagggtcattgtctacgggaccctgaatgtcaggtggagcacaggttctatggtaggggaggacatcgaggaataacacacaccgggacctgtgggrtcggggggcaaggggagggagagcatcagatcaaatagctaaggcatgtggggtttaatacataaatatatggactgggcatggtggcttatgcctgtaa

SEQ ID NO: 83548 - DNA, 201 bp, Homo sapiens; identical to SEQ ID NO: 64633

SEQ ID NO: 83549 - DNA, 201 bp, Homo sapiens
ccagtctgcatcagtatctcagggaaacaggaaaacaccattctccaaacacatgtcctagggtcccagggttgcatggcgaagcgggctgtgctgacaaygaggttcgtattatttctatttacctaaaagttcaagaaggccttgctgacattgttgcttggggcccagcatttaaacttagtcactgcccagagccct

SEQ ID NO: 83550 - DNA, 201 bp, Homo sapiens; identical to SEQ ID NO: 64745

SEQ ID NO: 83551 - DNA, 201 bp, Homo sapiens; identical to SEQ ID NO: 64634

SEQ ID NO: 83552 - DNA, 201 bp, Homo sapiens; identical to SEQ ID NO: 64635

SEQ ID NO: 83553 - DNA, 201 bp, Homo sapiens
ggcccagcatttaaacttagtcactgcccagagcccttgttttaggaaagaatgagatggtccctgttgcataacccagagttgggtgggtgtgggttgcmgaaggaaacaatccctcttcctctctcttgtgaggcctggctaggagtgcctgggatgggcgggacactgcctggggaaggcgggtggggagcggtggaa

SEQ ID NO: 83554 - DNA, 201 bp, Homo sapiens; identical to SEQ ID NO: 64748

SEQ ID NO: 83555 - DNA, 201 bp, Homo sapiens; identical to SEQ ID NO: 64636

SEQ ID NO: 83556 - DNA, 201 bp, Homo sapiens; identical to SEQ ID NO: 64637

SEQ ID NO: 83557 - DNA, 201 bp, Homo sapiens
tgtttattgcagcactattcacaatagcaaagacatagaaccaacccaaatgcatggaatactatgcagccataaaaaggaatgtgataatgtcctctgcrgggacatggatgaagctggaagccatcattctcagcaaactaacacaggaacagaaaaccaaacactacatgttctcacttataagtgggggctgaaaac

SEQ ID NO: 83558 - DNA, 201 bp, Homo sapiens; identical to SEQ ID NO: 64638

SEQ ID NO: 83559 - DNA, 201 bp, Homo sapiens; identical to SEQ ID NO: 64639

SEQ ID NO: 83560 - DNA, 201 bp, Homo sapiens; identical to SEQ ID NO: 64640

SEQ ID NO: 83561 - DNA, 201 bp, Homo sapiens; identical to SEQ ID NO: 64641

SEQ ID NO: 83562 - DNA, 201 bp, Homo sapiens; identical to SEQ ID NO: 64754

SEQ ID NO: 83563 - DNA, 201 bp, Homo sapiens; identical to SEQ ID NO: 64642

SEQ ID NO: 83564 - DNA, 201 bp, Homo sapiens; identical to SEQ ID NO: 64643

SEQ ID NO: 83565 - DNA, 201 bp, Homo sapiens; identical to SEQ ID NO: 64755

SEQ ID NO: 83566 - DNA, 201 bp, Homo sapiens; identical to SEQ ID NO: 64756

SEQ ID NO: 83567 - DNA, 201 bp, Homo sapiens; identical to SEQ ID NO: 64646

SEQ ID NO: 83568 - DNA, 201 bp, Homo sapiens; identical to SEQ ID NO: 64757

SEQ ID NO: 83569 - DNA, 201 bp, Homo sapiens
aagtgtaatcctggggtggtgggtggaactggactgtgcaatcgggcttagaatctagaaagtaacagctgggcaggtgggagcggcaggcagggagaatytgaggcagtggtagcagcgtgggaagcgggggctggaaattgaggagggttgaggagggagtggtggatgttagaagctggcaaagtgttgggctttttc

SEQ ID NO: 83570 - DNA, 201 bp, Homo sapiens
ctggaaattgaggagggttgaggagggagtggtggatgttagaagctggcaaagtgttgggctttttctgaacgataacctacaaaggagtagcacagccytttttttttttttttttttttttttttttttttctttgagacagggtctcactctggttgttccaggctggagtgcagtggtgtgatcttggctcatccc

SEQ ID NO: 83571 - DNA, 201 bp, Homo sapiens
cactctggttgttccaggctggagtgcagtggtgtgatcttggctcatcccttccaccttagcctcctaggtagctgggactaaaggcatgcaccaccacwtctggctgatattttgtatttttagtagagatggggcttggtcatgttgcccaggctggtctggaactcctgggctcaattgatcctcccaccttggcct

SEQ ID NO: 83572 - DNA, 201 bp, Homo sapiens; identical to SEQ ID NO: 64758

SEQ ID NO: 83573 - DNA, 201 bp, Homo sapiens
actctggttgttccaggctggagtgcagtggtgtgatcttggctcatcccttccaccttagcctcctaggtagctgggactaaaggcatgcaccaccacayctggctgatattttgtatttttagtagagatggggcttggtcatgttgcccaggctggtctggaactcctgggctcaattgatcctcccaccttggcctc

SEQ ID NO: 83574 - DNA, 201 bp, Homo sapiens
cccaaagtcccctgggcacaagacagtctgatgaatctagaaaaccccatggatgactgggagggaaggaaacggattctgggagaggagaggaatggagragcgagcttacctgaaggacggggatggggaggggggtggggtctgctctctggccactgtccccaagagcatcccgaatacgagttcctttaattctct

SEQ ID NO: 83575 - DNA, 201 bp, Homo sapiens
atggatgactgggagggaaggaaacggattctgggagaggagaggaatggaggagcgagcttacctgaaggacggggatggggaggggggtggggtctgcyctctggccactgtccccaagagcatcccgaatacgagttcctttaattctctccctctctagtttcaacctgccaatttccccctttccctgcctcccag

SEQ ID NO: 83576 - DNA, 201 bp, Homo sapiens
tgatccacacacaccatctcttctcagttccctttcagcccccgtcttctcactccccaccgggtccctgcatgcccctcgtcgtcctacacatacacacyaagtggattgcactcccgtcctccccttcttccgctcctccccaccctccagtccctccagccagctgtacagctcccaaattccgggccgagattcccg

SEQ ID NO: 83577 - DNA, 201 bp, Homo sapiens
aggtgggagcggcaggcagggagaatctgaggcagtggtagcagcgtgggaagcgggggctggaaattgaggagggttgaggagggagtggtggatgttaraagctggcaaagtgttgggctttttctgaacgataacctacaaaggagtagcacagccttttttttttttttttttttttttttttttttttctttgaga

SEQ ID NO: 83578 - DNA, 201 bp, Homo sapiens; identical to SEQ ID NO: 64652

SEQ ID NO: 83579 - DNA, 201 bp, Homo sapiens; identical to SEQ ID NO: 64653

SEQ ID NO: 83580 - DNA, 201 bp, Homo sapiens; identical to SEQ ID NO: 64654

SEQ ID NO: 83581 - DNA, 201 bp, Homo sapiens; identical to SEQ ID NO: 64655

SEQ ID NO: 83582 - DNA, 201 bp, Homo sapiens; identical to SEQ ID NO: 64763

SEQ ID NO: 83583 - DNA, 201 bp, Homo sapiens; identical to SEQ ID NO: 64764

SEQ ID NO: 83584 - DNA, 201 bp, Homo sapiens; identical to SEQ ID NO: 64765

SEQ ID NO: 83585 - DNA, 201 bp, Homo sapiens
cgttatccaccctctccatcttttctctgtccctccacatttgcccactcctcttgtgatccacacacaccatctcttctcagttccctttcagcccccgkcttctcactccccaccgggtccctgcatgcccctcgtcgtcctacacatacacactaagtggattgcactcccgtcctccccttcttccgctcctcccca

SEQ ID NO: 83586 - DNA, 201 bp, Homo sapiens; identical to SEQ ID NO: 64766

SEQ ID NO: 83587 - DNA, 201 bp, Homo sapiens; identical to SEQ ID NO: 64767

SEQ ID NO: 83588 - DNA, 201 bp, Homo sapiens; identical to SEQ ID NO: 64768

SEQ ID NO: 83589 - DNA, 201 bp, Homo sapiens; identical to SEQ ID NO: 64661

SEQ ID NO: 83590 - DNA, 201 bp, Homo sapiens; identical to SEQ ID NO: 64663

SEQ ID NO: 83591 - DNA, 201 bp, Homo sapiens; identical to SEQ ID NO: 64772

SEQ ID NO: 83592 - DNA, 201 bp, Homo sapiens; identical to SEQ ID NO: 64668

SEQ ID NO: 83593 - DNA, 201 bp, Homo sapiens; identical to SEQ ID NO: 64672

SEQ ID NO: 83594 - DNA, 201 bp, Homo sapiens; identical to SEQ ID NO: 64676

SEQ ID NO: 83595 - DNA, 201 bp, Homo sapiens; identical to SEQ ID NO: 64777

SEQ ID NO: 83596 - DNA, 201 bp, Homo sapiens; identical to SEQ ID NO: 64779

SEQ ID NO: 83597 - DNA, 201 bp, Homo sapiens; identical to SEQ ID NO: 64780

SEQ ID NO: 83598 - DNA, 201 bp, Homo sapiens; identical to SEQ ID NO: 64685

SEQ ID NO: 83599 - DNA, 201 bp, Homo sapiens; identical to SEQ ID NO: 64686

SEQ ID NO: 83600 - DNA, 201 bp, Homo sapiens
aaaaacaccgatatttcctggtgtctattctaaagtccttctatgggctggaagctggaggcccagagataaaaaaggaatgggggccctattctcaaaasacccacaatctaactggaaaaatgatgcaggaaaagaggagcaaaaatataaaatagcaacacaataatgtggatgaattaaaaggaaggcagggtgtca

SEQ ID NO: 83601 - DNA, 201 bp, Homo sapiens; identical to SEQ ID NO: 64781

SEQ ID NO: 83602 - DNA, 201 bp, Homo sapiens; identical to SEQ ID NO: 64690

SEQ ID NO: 83603 - DNA, 201 bp, Homo sapiens; identical to SEQ ID NO: 64691

SEQ ID NO: 83604 - DNA, 201 bp, Homo sapiens
ctccagccagctgtacagctcccaaattccgggccgagattcccgggaacaaagcaagaaaaatcagagcaatttgggaagtaaacagaaactggaaaggragagggaaagaagagtggggaggacccaggttgggggggccctctccagtcccacccagtttagggaatgcccctgccctctcccccaccccccttcacc

SEQ ID NO: 83605 - DNA, 201 bp, Homo sapiens; identical to SEQ ID NO: 64782

SEQ ID NO: 83606 - DNA, 201 bp, Homo sapiens; identical to SEQ ID NO: 64783

SEQ ID NO: 83607 - DNA, 201 bp, Homo sapiens; identical to SEQ ID NO: 64784

SEQ ID NO: 83608 - DNA, 201 bp, Homo sapiens; identical to SEQ ID NO: 64785

SEQ ID NO: 83609 - DNA, 201 bp, Homo sapiens; identical to SEQ ID NO: 64786

SEQ ID NO: 83610 - DNA, 201 bp, Homo sapiens; identical to SEQ ID NO: 64787

SEQ ID NO: 83611 - DNA, 201 bp, Homo sapiens; identical to SEQ ID NO: 64788

SEQ ID NO: 83612 - DNA, 201 bp, Homo sapiens; identical to SEQ ID NO: 64789

SEQ ID NO: 83613 - DNA, 201 bp, Homo sapiens; identical to SEQ ID NO: 64790

SEQ ID NO: 83614 - DNA, 201 bp, Homo sapiens; identical to SEQ ID NO: 64791

SEQ ID NO: 83615 - DNA, 201 bp, Homo sapiens; identical to SEQ ID NO: 64792

SEQ ID NO: 83616 - DNA, 201 bp, Homo sapiens
gtgctgaacatgtgcttcagatttctgccctgggtactaaggcagagggcatcccaatggcaggaaggcagagttcaagcgtctcagtctgcaaagagacyggttagaccctcagtgctgatggccatacaactggggatcatgctagagggagggggaaacagggaagtgtaatcctggggtggtgggtggaactggact

SEQ ID NO: 83617 - DNA, 201 bp, Homo sapiens; identical to SEQ ID NO: 64794

SEQ ID NO: 83618 - DNA, 201 bp, Homo sapiens; identical to SEQ ID NO: 64710

SEQ ID NO: 83619 - DNA, 201 bp, Homo sapiens; identical to SEQ ID NO: 64712

SEQ ID NO: 83620 - DNA, 201 bp, Homo sapiens; identical to SEQ ID NO: 64713

SEQ ID NO: 83621 - DNA, 201 bp, Homo sapiens; identical to SEQ ID NO: 64806

SEQ ID NO: 83622 - DNA, 201 bp, Homo sapiens
cttaattctcccagaatgacgtgtgacgagacgtgggaagtactgccaacttgggaagctctacgagccccggtgtccagaggttttatcagggctcaatsacatagacccagctgaccacccgcatggctgacctcagtctcagcccctccagaggctacgccgatagtgcggcccaaggccccaccatacatcacattg

SEQ ID NO: 83623 - DNA, 201 bp, Homo sapiens
accttctgtgctgtgcgtggtccatgccccaaggctggaggtgcaaaggggacaggtcccggaggctctggaagggcagagaagccaggcgtggaagggtrgggagagccctcggggcctctggcctctcccacagagacagcatgaaggaaggcctgggcgtgagaacagatgtgggggacacagaggcggaggccacgt

SEQ ID NO: 83624 - DNA, 201 bp, Homo sapiens
cggacgccccgaggaaggggcacctcaccgccccgacccagagcgcctggccgtgcgggctgcagaggacccctccggggcagaggcaggttccacggaaraccccggcccgctggggcttccccggagactccagagcccacagaggaggggccgcagggaacagccccgggcggcaggcgccgggcagcggcatctcgt

SEQ ID NO: 83625 - DNA, 201 bp, Homo sapiens
acatgaaatgacaatttgatactgtatttgatagaaaactatttttttgttaccggggtttacatagaagcacgttgtttataccactaagtgactttggsggggctctcccatggaaacggatggcactccctgaagctccctggtcacaggtggatgaaaacgtgtccgtgggtgacatcaggtggtgtctccaccacc

SEQ ID NO: 83626 - DNA, 201 bp, Homo sapiens
actcacgggtcacctcacactcacaggacacctcacacaagacacctcacacggggcacacttcacactcacaggtcacctcacacccacaggacacctcmcacagggcacacttcacactcacgggtcacctcacactcacaggacacctcacactcagggcgcacttcacactcacgggtcacctcacacccacaggac

SEQ ID NO: 83627 - DNA, 201 bp, Homo sapiens
cttgcaggcgggaatgagtggatgggtggatcaacagaggctgccacaggagagagggaggcctggcctgggaacagagctgtgaccgtgcccttccccarggtaggggctgaaggaccctcccatcctagtgacagggccacagcatgtccaaggaggccccagaggaggtcccgggagtcctgggagagcctggttagc

SEQ ID NO: 83628 - DNA, 201 bp, Homo sapiens
ttgcaggcgggaatgagtggatgggtggatcaacagaggctgccacaggagagagggaggcctggcctgggaacagagctgtgaccgtgcccttccccagrgtaggggctgaaggaccctcccatcctagtgacagggccacagcatgtccaaggaggccccagaggaggtcccgggagtcctgggagagcctggttagcc

SEQ ID NO: 83629 - DNA, 201 bp, Homo sapiens
gggttttgtgagagggatggtgcagcagcccccacacctgctactccgtgtggccgggtccagccccaggcaaggttccaggcatgcccctgggacagacrtgggagggagaccagcaggcaggtccccctcagggaggtatggagcgggtccccggggccaggtggagcccctcacacctgtgtcctcaaggacccacac

SEQ ID NO: 83630 - DNA, 201 bp, Homo sapiens
agcccagccagatagcccggttcctgccccctcccgcctgcccgcacagagagggctgcatgcaggtgagggtccatcacctgaagagcttcaccagcccsgaggccatgagccactgaatctctcagggggttttggcgcttgaggttccccaggtcattctgctgcccagagagggttgaggacctctgacctggagcc

SEQ ID NO: 83631 - DNA, 201 bp, Homo sapiens
tggaaagttccacattctgagaaccctcagtccctgggcaacctggggtggttagtcaccacagcttgtggcttgggcccatgacagcaggtagaaatgaygtggactgccgccagccgggcacagtggctcacgcctgtaatcccagcactttgggaggctgaggcatgtggatcacttgaggtcaggagttcgaaacca

SEQ ID NO: 83632 - DNA, 201 bp, Homo sapiens
gggcgagtcggggagtaccaaggaaggcctcagcaaagcagcatggaaataagacctgaaagcacggaagggccctccgggaggcgggtatgcaggcgcaraggccctggggccgagagctgtgtgtggagaccagcgtgaggggctggggcagctgggcccaaagacagattcacagacgccttccatcgccgctgcggt

SEQ ID NO: 83633 - DNA, 201 bp, Homo sapiens
aacatctggaaactacaaaatgagcacgaaatgatgtttttattcttagaacagaaagtccccacacccgcggccctggtgactgatgaggatgaggttcygaggggcctctctggccgcccagctctgcctggggaaggtggggccagagtggatgtgttcccagcgtggtcactcccctgcctcgccagcaggtctcgg

SEQ ID NO: 83634 - DNA, 201 bp, Homo sapiens
cgccacactggccaagctttagaccatttattccagagaccccagaggcaaaaagcccggctgcacctcccagtgactcccacagccattgagcagagacrctcaggaccttgtgatgggaggtttctgcactggagaacgagcccagaagccctctcagcctcggaacagtgtggccagtggtgggcaggtcaggagggg

SEQ ID NO: 83635 - DNA, 201 bp, Homo sapiens
caacagagcaagactctgtctcaaacaaacaaaacaaaacaaacaaaaagacgtaagatgtggaccgctggagaatgggggtgctgcctgcagtcaaaacrgagtgggggtgcccagctcagggccagaatgatcctattcccggcacttctcagtgaggctctgtggctcacctaagaaaccagcctcccttgcaggcaa

SEQ ID NO: 83636 - DNA, 201 bp, Homo sapiens
acgtgcacctgtggtcccagctactcaggaggctgaggcacaagaatcacttgaacccgggaggtggaggttgcagtgagattgcaccagtgcactctccmgcctggcaacagagcaagactctgtctcaaacaaacaaaacaaaacaaacaaaaagacgtaagatgtggaccgctggagaatgggggtgctgcctgcagt

SEQ ID NO: 83637 - DNA, 201 bp, Homo sapiens
cgctctgcagcacagctggggtcacctgacctttctcctgtcccccccacttgagctcagtggctgggcagcaggggatgcatggccactggccggccagstgcagctctcagctggggtgttcagaggacgcctgtgtcctcccctcccccatccctctgtcacccttggaggcagagaactttgcccgtcagtcccatg

SEQ ID NO: 83638 - DNA, 201 bp, Homo sapiens
cacaatgacgcacaatgtgtgcacaccaggctcatgtgcaggtggctgcgagacagggcgacccatcaaggcagatgcaccatgaggcagtggccagtgcygtgggtgttaggggcattgctccccggccactacggcatagcaggcagtgatcgccacactggccaagctttagaccatttattccagagaccccagagg

SEQ ID NO: 83639 - DNA, 201 bp, Homo sapiens
caagaatcacttgaacccgggaggtggaggttgcagtgagattgcaccagtgcactctccagcctggcaacagagcaagactctgtctcaaacaaacaaarcaaaacaaacaaaaagacgtaagatgtggaccgctggagaatgggggtgctgcctgcagtcaaaacggagtgggggtgcccagctcagggccagaatgat

SEQ ID NO: 83640 - DNA, 201 bp, Homo sapiens
ggcaggggcagcactgcagagatttcatcatggtctcccaggccctcaggctcctctgccttctgcttgggcttcagggctgcctggctgcaggtgcgtcyggggaggttttctccataaacttggtggaagggcagtgggcaaatccaggagccagcccgggcttcccaaaccccgcccttgctccggacacccccatcc

SEQ ID NO: 83641 - DNA, 201 bp, Homo sapiens
tgcagcaaaaattttaagtactgaaatcctttagaaccatccccattggcagcagaactgaacggggccccactactctccagcgccatttagccgcagtrctagtgactaccaccgcaaaggaaaaggaaacaaggccagcgcggcggctcacgcctgtcatcccagcactttgggaggccgaggcggcagatcacgagg

SEQ ID NO: 83642 - DNA, 201 bp, Homo sapiens
gcttttctgatgcaaatctgctttcaccccagggcggtcaccggctctgctcacaccagcctccaagggtgtgggtgtcccgggagtgtgggtgtcccggrggcgtgggtgtcccgggagtgtgggtgtcccgggggcgtgggtgtcccgggagtgtgggtgtcccgggggaagtgggtgtcccgggagtgtgggtgtccc

SEQ ID NO: 83643 - DNA, 201 bp, Homo sapiens
tctgatgcaaatctgctttcaccccagggcggtcaccggctctgctcacaccagcctccaagggtgtgggtgtcccgggagtgtgggtgtcccgggggcgwgggtgtcccgggagtgtgggtgtcccgggggcgtgggtgtcccgggagtgtgggtgtcccgggggaagtgggtgtcccgggagtgtgggtgtcccggggg

SEQ ID NO: 83644 - DNA, 201 bp, Homo sapiens
atctgctttcaccccagggcggtcaccggctctgctcacaccagcctccaagggtgtgggtgtcccgggagtgtgggtgtcccgggggcgtgggtgtcccrggagtgtgggtgtcccgggggcgtgggtgtcccgggagtgtgggtgtcccgggggaagtgggtgtcccgggagtgtgggtgtcccgggggagtgggtatc

SEQ ID NO: 83645 - DNA, 201 bp, Homo sapiens
agacaaggatgaccagctgatctgtgtgaacgagaacggcggctgtgagcagtactgcagtgaccacacgggcaccaagcgctcctgtcggtgccacgagrggtactctctgctggcagacggggtgtcctgcacacccacaggtgaccaggcttcatgtcccagtcccagatgacaccagtccctgtcccactacggatt

SEQ ID NO: 83646 - DNA, 201 bp, Homo sapiens
tcatgtggacagtccttaattctcccagaatgacgtgtgacgagacgtgggaagtactgccaacttgggaagctctacgagccccggtgtccagaggtttkatcagggctcaatcacatagacccagctgaccacccgcatggctgacctcagtctcagcccctccagaggctacgccgatagtgcggcccaaggccccac

SEQ ID NO: 83647 - DNA, 201 bp, Homo sapiens
cacgacctcagcgagcacgacggggatgagcagagccggcgggtggcgcaggtcatcatccccagcacgtacgtcccgggcaccaccaaccacgacatcgygctgctccgcctgcaccagcccgtggtcctcactgaccatgtggtgcccctctgcctgcccgaacggacgttctctgagaggacgctggccttcgtgcgc

SEQ ID NO: 83648 - DNA, 201 bp, Homo sapiens
ctggagctcatggtcctcaacgtgccccggctgatgacccaggactgcctgcagcagtcacggaaggtgggagactccccaaatatcacggagtacatgtyctgtgccggctactcggatggcagcaaggactcctgcaagggggacagtggaggcccacatgccacccactaccggggcacgtggtacctgacgggcatc

SEQ ID NO: 83649 - DNA, 201 bp, Homo sapiens
attttaaaagcagagttctttattgtatggatgacgtttgaataaatatcagcaactcctgccatctgcctttgtctgtcaagacacagaacgtctcagcrgtcggggtttccagggccgcagtgcactgtgcttgcacatggtaagtcattgttgggacggaaaagaagccggcagtgggcagggcccagcgtgcggctc

SEQ ID NO: 83650 - DNA, 201 bp, Homo sapiens
aaaactcgtaaaggctcctgggaaaatgggatgtttctccaaaccagcctggaacgaatgggctgcacttccaaaagcagggacaccccacacccactgtstctcaaagaggcggacgtgcccaccctggccacacagcctgggactcagcctgccacctcctcgggcttcctttctggcccaagaccttgattgaagcag

SEQ ID NO: 83651 - DNA, 201 bp, Homo sapiens
agaactgaacggggccccactactctccagcgccatttagccgcagtactagtgactaccaccgcaaaggaaaaggaaacaaggccagcgcggcggctcasgcctgtcatcccagcactttgggaggccgaggcggcagatcacgaggtcaggagatcgagaccatcctggctaacacggtgaaaccccgtctctattaaa

SEQ ID NO: 83652 - DNA, 201 bp, Homo sapiens
gtttgaggggtttgttttttttttaaccatctgaatattaaattatcacaaagtttgaggcccccaacctcccttgggttcagtaattcactagaaggacwcatagaatccactgaagtggatacactcacaggtaccgtttattacagcaaaggatgcaggcttaagtctgcagagggaccaggcacaagcttccccttg

SEQ ID NO: 83653 - DNA, 201 bp, Homo sapiens
gaatggagctcagttgtgtggggggaccctgatcaacaccatctgggtggtctccgcggcccactgtttcgacaaaatcaagaactggaggaacctgatcrcggtgctgggtgggtaccactctcccctgtccgaccgcggtgctgggtgggtgccactcttccctgtccgaccgcggtgctgggtgggtgccactctccc

SEQ ID NO: 83654 - DNA, 201 bp, Homo sapiens
aggcgagcacgacctcagcgagcacgacggggatgagcagagccggcgggtggcgcaggtcatcatccccagcacgtacgtcccgggcaccaccaaccacvacatcgcgctgctccgcctgcaccagcccgtggtcctcactgaccatgtggtgcccctctgcctgcccgaacggacgttctctgagaggacgctggcctt

SEQ ID NO: 83655 - DNA, 201 bp, Homo sapiens
cagtatcgatgacctgaaatgggattcaggacagttcatagagtaaagggggctgcgtggcaatcaggaactcataagccactgactataaagctcaaaayacagcaaagttggcagtcggcagacagcaatgttgactgtcatgaaaagtgatccctgtttgcccctaaacgtagagaaatctgcgttattttccagcac

SEQ ID NO: 83656 - DNA, 201 bp, Homo sapiens
agctggggtcacctgacctttctcctgtcccccccacttgagctcagtggctgggcagcaggggatgcatggccactggccggccaggtgcagctctcagstggggtgttcagaggacgcctgtgtcctcccctcccccatccctctgtcacccttggaggcagagaactttgcccgtcagtcccatggggaatgtcaaca

SEQ ID NO: 83657 - DNA, 201 bp, Homo sapiens
ctttggcctcaattcttcaccaggaatcactgtgtttacatgaaatgacaatttgatactgtatttgatagaaaactatttttttgttaccggggtttacrtagaagcacgttgtttataccactaagtgactttggcggggctctcccatggaaacggatggcactccctgaagctccctggtcacaggtggatgaaaac

SEQ ID NO: 83658 - DNA, 201 bp, Homo sapiens
gcacgacctcagcgagcacgacggggatgagcagagccggcgggtggcgcaggtcatcatccccagcacgtacgtcccgggcaccaccaaccacgacatcrcgctgctccgcctgcaccagcccgtggtcctcactgaccatgtggtgcccctctgcctgcccgaacggacgttctctgagaggacgctggccttcgtgcg

SEQ ID NO: 83659 - DNA, 201 bp, Homo sapiens
cacccctccgcagcccaccacacgcagcaccaggaggctgtgaatctccccactctgtaggaacagctgccgcttcctgggtccccattccccaacggaaygtgttccatgacatctgtgcagcatccgctgtgtgccaggcacagttctaggccccggagacaaagcgggaacagcacagacaggaacctccactcttac

SEQ ID NO: 83660 - DNA, 201 bp, Homo sapiens
cagcgagcacgacggggatgagcagagccggcgggtggcgcaggtcatcatccccagcacgtacgtcccgggcaccaccaaccacgacatcgcgctgctcygcctgcaccagcccgtggtcctcactgaccatgtggtgcccctctgcctgcccgaacggacgttctctgagaggacgctggccttcgtgcgcttctcatt

SEQ ID NO: 83661 - DNA, 201 bp, Homo sapiens
gatgcagacagcggctcatcaccggggggtccctcacgggtgtctgtctctcttaggttggagcaaaacgtcccactcactggaggcacctgaggacgacrggggctggtcaagtgcagaggagcagattaactcgtccgacgcagaggaggacggcgggttgggccccaagaagctggtaaccacggcttccctgtgggc

SEQ ID NO: 83662 - DNA, 201 bp, Homo sapiens
cagggtggcccagcaattggaagcagatggtctcaaaccctgaaacgtgccaggcattctggaagtttgcaggggtgtcctgctcagctctttatgaaccygggaagatgacaggctctgttgggggcccacggcacacatttcagggggtctgtgggacttagctgaccccacctcagacagatgcagacagcggctcat

SEQ ID NO: 83663 - DNA, 201 bp, Homo sapiens
acatgaccgtggcactcactgaaaacacctgcctgggagggcatctgcggcaggaaggctgcttccctcctggctgaggggcactgccctgcctgacaagrgcgtggcttcccagggcctggggatcgaggtctcccacagggtggcccagcaattggaagcagatggtctcaaaccctgaaacgtgccaggcattctgga

SEQ ID NO: 83664 - DNA, 201 bp, Homo sapiens
tctgtgtgaacgagaacggcggctgtgagcagtactgcagtgaccacacgggcaccaagcgctcctgtcggtgccacgaggggtactctctgctggcagayggggtgtcctgcacacccacaggtgaccaggcttcatgtcccagtcccagatgacaccagtccctgtcccactacggattatcttactggacaaaagacg

SEQ ID NO: 83665 - DNA, 201 bp, Homo sapiens
aatacaccagcccagcaacttggcggcctccctgcacacgcccctcgctttggtgtgaatgtgcaggttctgggcaggaggtctggggtggtccctagatragcccactcccaggccccacagccgggtccacagaccccacagccgggtccacagaccccactgggctctctgggacgtggagaaaatcaggaagcgtcc

SEQ ID NO: 83666 - DNA, 201 bp, Homo sapiens
cgtggtgcccacagctcacggcgctcccgggtgacggtcccctcggctgtagggcgtcctgaagagcggcctgctcggagctgagcgcacggggttgcctsgccctgggcgtctctggccctcaccagccccgtcttcccatgggcaaaacggcggtcctgtttgtccacaagtaaccgtcggggttacggaggggccagg

SEQ ID NO: 83667 - DNA, 201 bp, Homo sapiens
gggatttggatttccgcgggcggctgcacggatttccacgcgcggttcacgtgggccccaggggggtgcccggcacccggggccgcgccgccttctcctcsccggcatcgacccgcagcctcacgtttacgcggcggcgcccgcagcccccttcggcccggcttccgcgcgtgcccccgagcgcgccctcgggatcagccc

SEQ ID NO: 83668 - DNA, 201 bp, Homo sapiens
gacacctcacagaggtcacctcacacccacaggacacctcacagaggtcacctcacacggggcacacttcacactcaggtcacctcacacccacaggacamctcacagaggtcacctcacacccacaggacaactcacagaggtcacctcacacaggacacctcacaaaggtcacctcacacccacaggacacctcacact

SEQ ID NO: 83669 - DNA, 201 bp, Homo sapiens
ggatgagcagagccggcgggtggcgcaggtcatcatccccagcacgtacgtcccgggcaccaccaaccacgacatcgcgctgctccgcctgcaccagcccrtggtcctcactgaccatgtggtgcccctctgcctgcccgaacggacgttctctgagaggacgctggccttcgtgcgcttctcattggtcagcggctgggg

SEQ ID NO: 83670 - DNA, 201 bp, Homo sapiens
tacatgttctgtgccggctactcggatggcagcaaggactcctgcaagggggacagtggaggcccacatgccacccactaccggggcacgtggtacctgaygggcatcgtcagctggggccagggctgcgcaaccgtgggccactttggggtgtacaccagggtctcccagtacatcgagtggctgcaaaagctcatgcgc

SEQ ID NO: 83671 - DNA, 201 bp, Homo sapiens
ggacactgcaggcggcggtgaaccaggccgcgtggggccgcctgcgtctctttggctgcggctgtgggcggcgaacacgcagcggcgcccgcgcggcgctytctgcgggggtcgctttccgcccggggtgactccgctttcctgggcgatgccccccacccccaggcacgcgctctccccgtgcggccgcaccgcgcatgc

SEQ ID NO: 83672 - DNA, 201 bp, Homo sapiens
ttgccccagaaggagactgcagcccctgcagacctagaaatggccacagcccatccccatgcaccagggggtgaggtggcaggtggtggaaagggcctgargggggcttcttccttccaggcgagcacgacctcagcgagcacgacggggatgagcagagccggcgggtggcgcaggtcatcatccccagcacgtacgtcc

SEQ ID NO: 83673 - DNA, 201 bp, Homo sapiens
accaaccacgacatcgcgctgctccgcctgcaccagcccgtggtcctcactgaccatgtggtgcccctctgcctgcccgaacggacgttctctgagaggaygctggccttcgtgcgcttctcattggtcagcggctggggccagctgctggaccgtggcgccacggccctggagctcatggtcctcaacgtgccccggctg

SEQ ID NO: 83674 - DNA, 201 bp, Homo sapiens
gaggggggcttcttccttccaggcgagcacgacctcagcgagcacgacggggatgagcagagccggcgggtggcgcaggtcatcatccccagcacgtacgwcccgggcaccaccaaccacgacatcgcgctgctccgcctgcaccagcccgtggtcctcactgaccatgtggtgcccctctgcctgcccgaacggacgttc

SEQ ID NO: 83675 - DNA, 201 bp, Homo sapiens
tcttccttccaggcgagcacgacctcagcgagcacgacggggatgagcagagccggcgggtggcgcaggtcatcatccccagcacgtacgtcccgggcacyaccaaccacgacatcgcgctgctccgcctgcaccagcccgtggtcctcactgaccatgtggtgcccctctgcctgcccgaacggacgttctctgagagga

SEQ ID NO: 83676 - DNA, 201 bp, Homo sapiens
agttttaaaaaagaaacactcccccgcccccccccccgccccccgaaaaaaaaagcctcatacttcagagcaagtagggtgggcgtctgttctcatccagyccgtccgggtttaacttagaagtgtgtggcccctcagaagcaggagggtgggcgtctgctctcatccagtccgtccgggtttaacttagaagtgtgtggc

SEQ ID NO: 83677 - DNA, 201 bp, Homo sapiens
tcatggtcctcaacgtgccccggctgatgacccaggactgcctgcagcagtcacggaaggtgggagactccccaaatatcacggagtacatgttctgtgcyggctactcggatggcagcaaggactcctgcaagggggacagtggaggcccacatgccacccactaccggggcacgtggtacctgacgggcatcgtcagct

SEQ ID NO: 83678 - DNA, 201 bp, Homo sapiens
agaccccacagccgggtccacagaccccactgggctctctgggacgtggagaaaatcaggaagcgtcccttgcttggagggcacgcatctccagcaggaaygcagctcagacctcctcactccttgtcttctcctggggaggaggcgtggctcggagcagacgtgacttctgttttctgggctgcgatttgcaggctggtg

SEQ ID NO: 83679 - DNA, 201 bp, Homo sapiens
tgcaagaagagggaggagaatggggaggggtatgagaaagctccctcctacagctacaagcagtccttaaacgtaagtgaggccgggtctgcagcagcacrctcctggccacagaccccgacgggggaagtctgtaactcggtctgaggtggacacgctgacacccagctctcagccttaggtgtaggggtggggtattct

SEQ ID NO: 83680 - DNA, 201 bp, Homo sapiens
cctgcctcagcctcccgaggagctgggactacaggcgcccgccaccacgcccggctcattttttgtatttttagtagagacggggtttcactgcgttagcygggatggtctcgatctcctgacctcgtgatctcccacctcagcctcccaaagtgctgggattacaggcgtgagccaccgcgcccggctgcagcaaaaatt

SEQ ID NO: 83681 - DNA, 201 bp, Homo sapiens
ggccagctgtggctccctggggctgagagtcagacgggcggatcagaggtcacagagacaaaaacacaaggacagagtcagagagagaaagggagagggarggagaaacggagacacagtgagatgggaggccaagaggcagagacagaggtagaaagacggagacagagagagagggaggggttggggcaggcagagaca

SEQ ID NO: 83682 - DNA, 201 bp, Homo sapiens
acaggacacctccctctcacaggtcaccttacactcatctcacactcacaggtcgccacacctcacactcacaggatgcctcacactcacagaaccacatytcatatgcacaagacacctcacactcaggacacctcatgctcaaagaagcctcacactcacaggaggtccagctgtctgaggcaaaggctaacatgaccc

SEQ ID NO: 83683 - DNA, 201 bp, Homo sapiens
atgacaaccaaagttttcctgtgtcctccacactcaagagtgactgtgaggcggaggggcccagcccttcttgcaggcgggaatgagtggatgggtggatyaacagaggctgccacaggagagagggaggcctggcctgggaacagagctgtgaccgtgcccttccccagggtaggggctgaaggaccctcccatcctagt

SEQ ID NO: 83684 - DNA, 201 bp, Homo sapiens
accaaatcccatatattcttctgcagttaatggggtagaggagggcatgggagggagggagaggtggggagggagacagagacagaaacagagagagacaragacagagagagactgagggagagactctgaggacatggagagagactcaaagagactccaagattcaaagagactaatagagacacagagatggaatag

SEQ ID NO: 83685 - DNA, 201 bp, Homo sapiens
atatcagaagcaagaaaaagctgccatgtgttaatcattccagtgagggttacaccaagaagtgtctgctgcaccttctgtgctgtgcgtggtccatgccycaaggctggaggtgcaaaggggacaggtcccggaggctctggaagggcagagaagccaggcgtggaagggtggggagagccctcggggcctctggcctct

SEQ ID NO: 83686 - DNA, 201 bp, Homo sapiens
tgccaccaggaaggcccttctcagaggaccaggctgtgcgtggtgcccgccgtgggaggccagcctggcgttggcatccagcatcatcagtttgtgcagtygggtggggctcagtgagtgcctcctgtgtgccaggcacaatgacgcacaatgtgtgcacaccaggctcatgtgcaggtggctgcgagacagggcgaccca

SEQ ID NO: 83687 - DNA, 201 bp, Homo sapiens
cgcgctgctccgcctgcaccagcccgtggtcctcactgaccatgtggtgcccctctgcctgcccgaacggacgttctctgagaggacgctggccttcgtgygcttctcattggtcagcggctggggccagctgctggaccgtggcgccacggccctggagctcatggtcctcaacgtgccccggctgatgacccaggactg

SEQ ID NO: 83688 - DNA, 201 bp, Homo sapiens
cctgcaccagcccgtggtcctcactgaccatgtggtgcccctctgcctgcccgaacggacgttctctgagaggacgctggccttcgtgcgcttctcattgktcagcggctggggccagctgctggaccgtggcgccacggccctggagctcatggtcctcaacgtgccccggctgatgacccaggactgcctgcagcagtc

SEQ ID NO: 83689 - DNA, 201 bp, Homo sapiens
atccctctgtcacccttggaggcagagaactttgcccgtcagtcccatggggaatgtcaacaggcaggggcagcactgcagagatttcatcatggtctccyaggccctcaggctcctctgccttctgcttgggcttcagggctgcctggctgcaggtgcgtccggggaggttttctccataaacttggtggaagggcagtg

SEQ ID NO: 83690 - DNA, 201 bp, Homo sapiens
accagcccgtggtcctcactgaccatgtggtgcccctctgcctgcccgaacggacgttctctgagaggacgctggccttcgtgcgcttctcattggtcagsggctggggccagctgctggaccgtggcgccacggccctggagctcatggtcctcaacgtgccccggctgatgacccaggactgcctgcagcagtcacgga

SEQ ID NO: 83691 - DNA, 201 bp, Homo sapiens
gagcagctttgcctgggagggatctgcaaagaccccaggatttcagaaagaaattgtgcaatgccagaggttccttggcatgcccgggagggcgagtcatragagaaacaatgacagcaatgtgacttccacacctcctgtccccccgcccaggtcctgttgttggtgaatggagctcagttgtgtggggggaccctgatc

SEQ ID NO: 83692 - DNA, 201 bp, Homo sapiens
caacagccatcccagctggggcgtggactttgctccagcagcctgtcccagtgaggacagggacacagtactcggccacaccatggggcgcccactgcacmtcgtcctgctcagtgcctccctggctggcctcctgctgctcggggaaagtcgtaagtgcccctcgcccttcagacccaaaagcagcgccagggagcaggg

SEQ ID NO: 83693 - DNA, 201 bp, Homo sapiens
ggggcacgcggtgggcgcttcacggaactcgcatttcccagtcttcgtaacccaggaggaagcccacggcgtcctgcaccggcgccggcgcgccaacgcgytcctggaggagctgcggccgggctccctggagagggagtgcaaggaggagcagtgctccttcgaggaggcccgggagatcttcaaggacgcggagaggac

SEQ ID NO: 83694 - DNA, 201 bp, Homo sapiens
gagctgcctaatgcacagctggacaggtgggggcagcagggctgtccaggacccccgggtctgtccaaaagcagaggcccagacaggacagaagccaggcmagcctggggacagcggaggaagaggaggcccctctggtggggacacgagagacagggaccctagacttgtttgcatcctggacaaagtggacaggcaggg

SEQ ID NO: 83695 - DNA, 201 bp, Homo sapiens
tcgcatttcccagtcttcgtaacccaggaggaagcccacggcgtcctgcaccggcgccggcgcgccaacgcgttcctggaggagctgcggccgggctcccwggagagggagtgcaaggaggagcagtgctccttcgaggaggcccgggagatcttcaaggacgcggagaggacggtgagcccagcctcggggcgccccgcg

SEQ ID NO: 83696 - DNA, 201 bp, Homo sapiens
cgtaacccaggaggaagcccacggcgtcctgcaccggcgccggcgcgccaacgcgttcctggaggagctgcggccgggctccctggagagggagtgcaagsaggagcagtgctccttcgaggaggcccgggagatcttcaaggacgcggagaggacggtgagcccagcctcggggcgccccgcgccgcggacactgcaggc

SEQ ID NO: 83697 - DNA, 201 bp, Homo sapiens
ggaagcccacggcgtcctgcaccggcgccggcgcgccaacgcgttcctggaggagctgcggccgggctccctggagagggagtgcaaggaggagcagtgcyccttcgaggaggcccgggagatcttcaaggacgcggagaggacggtgagcccagcctcggggcgccccgcgccgcggacactgcaggcggcggtgaacca

SEQ ID NO: 83698 - DNA, 201 bp, Homo sapiens
cactctgcagacagatgcttcagtgaattggtagaaaattctgcaaccagaatgcccggggctcctgagggcctaagcccagcccagggttctggaagccrctctgacttcttgggagtggaagttggcaggactcttcctgggaagaagcggagggtggggatgagaggacagttcaggagcccacccagacccacagga

SEQ ID NO: 83699 - DNA, 201 bp, Homo sapiens
gtggtgcccacagctcacggcgctcccgggtgacggtcccctcggctgtagggcgtcctgaagagcggcctgctcggagctgagcgcacggggttgcctcsccctgggcgtctctggccctcaccagccccgtcttcccatgggcaaaacggcggtcctgtttgtccacaagtaaccgtcggggttacggaggggccagga

SEQ ID NO: 83700 - DNA, 201 bp, Homo sapiens
cagcacgtacgtcccgggcaccaccaaccacgacatcgcgctgctccgcctgcaccagcccgtggtcctcactgaccatgtggtgcccctctgcctgcccraacggacgttctctgagaggacgctggccttcgtgcgcttctcattggtcagcggctggggccagctgctggaccgtggcgccacggccctggagctcat

SEQ ID NO: 83701 - DNA, 201 bp, Homo sapiens
cactgtttcgacaaaatcaagaactggaggaacctgatcgcggtgctgggtgggtaccactctcccctgtccgaccgcggtgctgggtgggtgccactctyccctgtccgaccgcggtgctgggtgggtgccactctcccctgtccgaccgcggtgctgggtgggtgccactctcccctgtccgaccgcggtgctgggtgg

SEQ ID NO: 83702 - DNA, 201 bp, Homo sapiens
tgagaggacgctggccttcgtgcgcttctcattggtcagcggctggggccagctgctggaccgtggcgccacggccctggagctcatggtcctcaacgtgmcccggctgatgacccaggactgcctgcagcagtcacggaaggtgggagactccccaaatatcacggagtacatgttctgtgccggctactcggatggcag

SEQ ID NO: 83703 - DNA, 201 bp, Homo sapiens
ggaccgcttggtaaacttccccttctctactttccattacaaaggtttgaggggtttgttttttttttaaccatctgaatattaaattatcacaaagtttraggcccccaacctcccttgggttcagtaattcactagaaggactcatagaatccactgaagtggatacactcacaggtaccgtttattacagcaaaggat

SEQ ID NO: 83704 - DNA, 201 bp, Homo sapiens
gagaggacgctggccttcgtgcgcttctcattggtcagcggctggggccagctgctggaccgtggcgccacggccctggagctcatggtcctcaacgtgcsccggctgatgacccaggactgcctgcagcagtcacggaaggtgggagactccccaaatatcacggagtacatgttctgtgccggctactcggatggcagc

SEQ ID NO: 83705 - DNA, 201 bp, Homo sapiens
atcaccaccagtcctgcctgcaacccttctcagcttactgacaccagcccactccacagatggggaccagtgtgcctcaagtccatgccagaatgggggcycctgcaaggaccagctccagtcctatatctgcttctgcctccctgccttcgagggccggaactgtgagacgcgtaaggccccactttgggtcccatattt

SEQ ID NO: 83706 - DNA, 201 bp, Homo sapiens
ccaccagtcctgcctgcaacccttctcagcttactgacaccagcccactccacagatggggaccagtgtgcctcaagtccatgccagaatgggggctcctkcaaggaccagctccagtcctatatctgcttctgcctccctgccttcgagggccggaactgtgagacgcgtaaggccccactttgggtcccatatttgcag

SEQ ID NO: 83707 - DNA, 201 bp, Homo sapiens
gaaattcggaaagtgctgaccagccagctgcaggcttgtagaggtgaggctgtcttcaagcgatcgtttcccgtagcttccgctccaggtgcatttttacytatgttcagagcaaccgcacagtccccgcatgcgcaaggtgcctcggcgttgaagtaaagacgctcgttcacgtggtttgtctgctccctcctcgcagaa

SEQ ID NO: 83708 - DNA, 201 bp, Homo sapiens
cgcgtccatggccccaggcccatcccgtcctgaacacagccctgctgtcgcacatttaggggaatctcggcgacctgggcaagctgctgatgcagggctcrttcagcgtctggaccgaccacaagaggggccacaccaaggtgaaggagctggccaggttcaagcccatgcagcggcacctgttcctgcacgagaaggcag

SEQ ID NO: 83709 - DNA, 201 bp, Homo sapiens
aggcgatgtcagagggtggagaccaggagaggcaggagtcagacatctggtgccaccaggaaggcccttctcagaggaccaggctgtgcgtggtgcccgcmgtgggaggccagcctggcgttggcatccagcatcatcagtttgtgcagttgggtggggctcagtgagtgcctcctgtgtgccaggcacaatgacgcacaa

SEQ ID NO: 83710 - DNA, 201 bp, Homo sapiens
tccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcatt

SEQ ID NO: 83711 - DNA, 201 bp, Homo sapiens
tccctgcagggccgtcctgggcaccactggcactcacagcagcaaggtgggcaccattggcactcacagcagcaaggcaggcaccagcaacccacctcggrggcactcaggcatcatctacttcagagcagacagggtctatgaactacagccgtgggctgcttccaaggcaccctgctcttgtaaataaagttttatggg

SEQ ID NO: 83712 - DNA, 201 bp, Homo sapiens
gagaaccctgcgagatgccccatccgagttgtcacgtcgtcctcacggttactctttgaggtgggatctttgcctgatctttgcaaaatcaggagcattgratcaaagctatgtgaagatcctgtgaggtgaacagtgaaatctcacagcgacatttgtattcttgggccgtgcccaagagcacgtctcggctagagaggg

SEQ ID NO: 83713 - DNA, 201 bp, Homo sapiens
ccccagacaaggatgaccagctgatctgtgtgaacgagaacggcggctgtgagcagtactgcagtgaccacacgggcaccaagcgctcctgtcggtgccaygaggggtactctctgctggcagacggggtgtcctgcacacccacaggtgaccaggcttcatgtcccagtcccagatgacaccagtccctgtcccactacg

SEQ ID NO: 83714 - DNA, 201 bp, Homo sapiens
cgtagaacagtagttttaaaaaagaaacactcccccgcccccccccccgccccccgaaaaaaaaagcctcatacttcagagcaagtagggtgggcgtctgytctcatccagcccgtccgggtttaacttagaagtgtgtggcccctcagaagcaggagggtgggcgtctgctctcatccagtccgtccgggtttaacttag

SEQ ID NO: 83715 - DNA, 201 bp, Homo sapiens
ctcggccgagcgtgcaacccggagccgccttgggccctccctgcgacagccggacccgcctccgcatcgggttgcgatgccctctgcatagtttctttctyttccttcatagatgacacggtcactagctctgcctcagaaagctctgcgctttccagaaagcgctttaccctgcagggttttgctaacctcaaaggtcag

SEQ ID NO: 83716 - DNA, 201 bp, Homo sapiens
catggtcctcaacgtgccccggctgatgacccaggactgcctgcagcagtcacggaaggtgggagactccccaaatatcacggagtacatgttctgtgccrgctactcggatggcagcaaggactcctgcaagggggacagtggaggcccacatgccacccactaccggggcacgtggtacctgacgggcatcgtcagctg

SEQ ID NO: 83717 - DNA, 201 bp, Homo sapiens
ttgcgatgccctctgcatagtttctttctcttccttcatagatgacacggtcactagctctgcctcagaaagctctgcgctttccagaaagcgctttaccytgcagggttttgctaacctcaaaggtcagaaaggtaaaagtagtgcctgccccaaacccaccctcaccgtggtggcgtctgtcatgcatcgtgtgtgacc

SEQ ID NO: 83718 - DNA, 201 bp, Homo sapiens
caccagtcctgcctgcaacccttctcagcttactgacaccagcccactccacagatggggaccagtgtgcctcaagtccatgccagaatgggggctcctgmaaggaccagctccagtcctatatctgcttctgcctccctgccttcgagggccggaactgtgagacgcgtaaggccccactttgggtcccatatttgcaga

SEQ ID NO: 83719 - DNA, 201 bp, Homo sapiens
aaaggtgggtatgtgcagggaccgggcctcacacggaggcctcacacggagctgctcacggagtgctcactgcatccgagaaacctgcgcttcctgcagtrtgaagaagctttgcagagcattcagggccccttgctcccctcttaacagagccctaggaccccacagaagagcccctccctctccattgctctgcacccc

SEQ ID NO: 83720 - DNA, 201 bp, Homo sapiens
cctgcaacccttctcagcttactgacaccagcccactccacagatggggaccagtgtgcctcaagtccatgccagaatgggggctcctgcaaggaccagcyccagtcctatatctgcttctgcctccctgccttcgagggccggaactgtgagacgcgtaaggccccactttgggtcccatatttgcagagggccctgggg

SEQ ID NO: 83721 - DNA, 201 bp, Homo sapiens
tagagtggcaccctcgggcacggcacccactctgcgttggcaggaagcgcggcccagctggctgtcaggtggccgtcaaggccacctaagggggatgctckcgtgggtctttatgctgcggaggcagacacgcggttgtgttcaatgtgtgatgctctggtgacaggtcctcgaggacagcacgcctctcagccaactcct

SEQ ID NO: 83722 - DNA, 201 bp, Homo sapiens
cttctcagcttactgacaccagcccactccacagatggggaccagtgtgcctcaagtccatgccagaatgggggctcctgcaaggaccagctccagtcctrtatctgcttctgcctccctgccttcgagggccggaactgtgagacgcgtaaggccccactttgggtcccatatttgcagagggccctggggagctggtgg

SEQ ID NO: 83723 - DNA, 201 bp, Homo sapiens
ttgcaatcttgagttttcaaaaatttgcaaaggttcccaggggtgtaagcagaaccagccttcccattccgcccgcctccacagcctcctcacatgacacrgcgagcctcacagaaccaggcagaagctgtggccaccctgggcatgagttcagaggcagggagctggcccggcgttactgactgtcctgcctgcaagtgg

SEQ ID NO: 83724 - DNA, 201 bp, Homo sapiens
actccagagcccacagaggaggggccgcagggaacagccccgggcggcaggcgccgggcagcggcatctcgtcctggctccaccgtgctgcttctgcctcyggacggtgctttcaggggacgcgcggaccgtggtggagctgcttccggagaagtggaggatcctctggccaacggcctgaggagagcggggcacggggtc

SEQ ID NO: 83725 - DNA, 201 bp, Homo sapiens
cagccacggccagctcagattggtgtcgacagcttagtggtgtctgattttatacatgacaaaatgaacgagttaaccatttaagccaaaaaaataagacyagcgtaacccaaagaaagtatttaaatacttctgtcaattaggacagttgagaaaagagaataacaaaatcaaaagcaaaactcaaactttgtacctgaa

SEQ ID NO: 83726 - DNA, 201 bp, Homo sapiens
acggagcaggtggtgccaagctcaggctctgtcacccacagctcagtgccaccttccaggcagaacaccactgctgacccagggcatggccaccccggggrctggctctcgctgacccccagaagcccctctcagggtgtccccttcctgtccccagacaaggatgaccagctgatctgtgtgaacgagaacggcggctgt

SEQ ID NO: 83727 - DNA, 201 bp, Homo sapiens
gagctccccggggagcaggtgcgaggggtttgcacctggcatcagggtggcaggagggagctccccggggagcaggtgcgaggggtttgcacctggcatcmgggtggcaggagggagctccccggggagcaggtgcgaggggtttgcacctggcatccgggtggcaggagggagctccccggggagcaggtgccaagggtc

SEQ ID NO: 83728 - DNA, 201 bp, Homo sapiens
gacacccccatccaccaggagggttttctggcggctcctgttcaatttctttccttctagaaaccagcatccaggcacaggaggggaggcccttcttggtrgcccaggctttggcgggattatttttcaaagaactttaggagtgggtggtgctttcctggcccccatgggcccctgcctgtgaggtcggacaagcgcagg

SEQ ID NO: 83729 - DNA, 201 bp, Homo sapiens
caaaatcaaggcgtcagcggggctggttcctccagaggctgggagagagtctgctctaggcctgtttcctggcctcggggtgccagcggcctcacagcccrtggcttgtgggagcattgctcccatcgctgcctccatcatcgcatggggttctcaccatggctgtttttctgtcttcttttctctcagaaggacaccagt

SEQ ID NO: 83730 - DNA, 201 bp, Homo sapiens
ggaacaaggccctggaaggacccatgccatcatcatcgacagcaaagctactctgcaaacagacagatgcttccgcgaattggtagaaaattctgcagccrgaatgctctaggatcctgaggccctaagcccggcccggggctcccgaggccctaagcccggcccgggactctggaagctgctctggcttattgggaatgg

SEQ ID NO: 83731 - DNA, 201 bp, Homo sapiens
cccgcagcccccttcggcccggcttccgcgcgtgcccccgagcgcgccctcgggatcagcccccggaagcagagaggccaggccgggaaggatgggcgacsggggtggctgacccgggagcacggcagggaggacacccagccaggcccgcgagcagcgccgctcccctcctccaggacgggcgggaacctgcgatgcccc

SEQ ID NO: 83732 - DNA, 201 bp, Homo sapiens
cgggagatcttcaaggacgcggagaggacggtgagcccagcctcggggcgccccgcgccgcggacactgcaggcggcggtgaaccaggccgcgtggggccrcctgcgtctctttggctgcggctgtgggcggcgaacacgcagcggcgcccgcgcggcgctttctgcgggggtcgctttccgcccggggtgactccgcttt

SEQ ID NO: 83733 - DNA, 201 bp, Homo sapiens
gagcagctttgcctgggagggatctgcaaagaccccaggatttcagaaagaaattgtgcaatgccagaggttccttggcatgcccgggagggcgagtcatsagagaaacaatgacagcaatgtgacttccacacctcctgtccccccgcccaggtcctgttgttggtgaatggagctcagttgtgtggggggaccctgatc

SEQ ID NO: 83734 - DNA, 201 bp, Homo sapiens
ctgcctgcagcagtcacggaaggtgggagactccccaaatatcacggagtacatgttctgtgccggctactcggatggcagcaaggactcctgcaaggggvacagtggaggcccacatgccacccactaccggggcacgtggtacctgacgggcatcgtcagctggggccagggctgcgcaaccgtgggccactttggggt

SEQ ID NO: 83735 - DNA, 201 bp, Homo sapiens
ctgtcactgagccttcctaactatacatacaattctcattttgtaagaaaatggaactgctaagcatggatttgcatttgaaaaaacattcattgttaatrtcagaagcaagaaaaagctgccatgtgttaatcattccagtgagggttacaccaagaagtgtctgctgcaccttctgtgctgtgcgtggtccatgcccca

SEQ ID NO: 83736 - DNA, 201 bp, Homo sapiens
gccggctactcggatggcagcaaggactcctgcaagggggacagtggaggcccacatgccacccactaccggggcacgtggtacctgacgggcatcgtcakctggggccagggctgcgcaaccgtgggccactttggggtgtacaccagggtctcccagtacatcgagtggctgcaaaagctcatgcgctcagagccacgc

SEQ ID NO: 83737 - DNA, 201 bp, Homo sapiens
acaaatctctgcatctttctgacttttgttttacacagttgaatatccatgtggaaaaatacctattctagaaaaaagaaatgccagcaaaccccaaggcygaattgtggggggcaaggtgtgccccaaaggggagtgtccatggcaggtaaggcttcccctggcttcaggattccaagccctgagggtcttgaagccttt

SEQ ID NO: 83738 - DNA, 201 bp, Homo sapiens
ccagggttagggtggcgagaggaaactccccagggagcaggtgcgaggggtttgcacctggcatcagggtggcaggagggagctccccggggagcaggtgygaggggtttgcacctggcatcagggtggcaggagggagctccccggggagcaggtgcgaggggtttgcacctggcatcagggtggcaggagggagctccc

SEQ ID NO: 83739 - DNA, 201 bp, Homo sapiens
cgaacggacgttctctgagaggacgctggccttcgtgcgcttctcattggtcagcggctggggccagctgctggaccgtggcgccacggccctggagctcrtggtcctcaacgtgccccggctgatgacccaggactgcctgcagcagtcacggaaggtgggagactccccaaatatcacggagtacatgttctgtgccgg

SEQ ID NO: 83740 - DNA, 201 bp, Homo sapiens
atggtcctcaacgtgccccggctgatgacccaggactgcctgcagcagtcacggaaggtgggagactccccaaatatcacggagtacatgttctgtgccgrctactcggatggcagcaaggactcctgcaagggggacagtggaggcccacatgccacccactaccggggcacgtggtacctgacgggcatcgtcagctgg

SEQ ID NO: 83741 - DNA, 201 bp, Homo sapiens
gactgcctgcagcagtcacggaaggtgggagactccccaaatatcacggagtacatgttctgtgccggctactcggatggcagcaaggactcctgcaaggrggacagtggaggcccacatgccacccactaccggggcacgtggtacctgacgggcatcgtcagctggggccagggctgcgcaaccgtgggccactttggg

SEQ ID NO: 83742 - DNA, 201 bp, Homo sapiens
acgcagccacctgacctttgactcctaagattatctttggatgttccgagagtgaaaccaaagcgtgtttcctcgggggcctgagtactcacctcctggcrtttcttttggggaaacaggcgccaactcctgagattaaagccgcgtgggtgaatgaaattcggaaagtgctgaccagccagctgcaggcttgtagaggtg

SEQ ID NO: 83743 - DNA, 201 bp, Homo sapiens
gccccctaaacgggacgggagccagtggcgggccctgatccaggtcagagctggctctgctttctcttttgtccgagtgaccatgcctcagtttcctcatstgtaaaacaggagcccaccgtgatgcttatggtgggatgagatcagcatggatggaacaaggccctggaagggcccatgccatggtcatcgacagcaaag

SEQ ID NO: 83744 - DNA, 201 bp, Homo sapiens
tccccaaatatcacggagtacatgttctgtgccggctactcggatggcagcaaggactcctgcaagggggacagtggaggcccacatgccacccactaccrgggcacgtggtacctgacgggcatcgtcagctggggccagggctgcgcaaccgtgggccactttggggtgtacaccagggtctcccagtacatcgagtgg

SEQ ID NO: 83745 - DNA, 201 bp, Homo sapiens
ccagccatctactctcaggtgggaaaggggtagggtttagatatggccccctcccctccacgtcctgaaattaccttgggctgtgctggccgagagccgcrgggaccagatttgagctggacgtgagctttattccagacggagcagctactttgtaagcgatctccctgggatcgatatcatggaggggcacagatgggc

SEQ ID NO: 83746 - DNA, 201 bp, Homo sapiens
gctactcggatggcagcaaggactcctgcaagggggacagtggaggcccacatgccacccactaccggggcacgtggtacctgacgggcatcgtcagctgvggccagggctgcgcaaccgtgggccactttggggtgtacaccagggtctcccagtacatcgagtggctgcaaaagctcatgcgctcagagccacgcccag

SEQ ID NO: 83747 - DNA, 201 bp, Homo sapiens
ggggacagtggaggcccacatgccacccactaccggggcacgtggtacctgacgggcatcgtcagctggggccagggctgcgcaaccgtgggccactttgrggtgtacaccagggtctcccagtacatcgagtggctgcaaaagctcatgcgctcagagccacgcccaggagtcctcctgcgagccccatttccctagccc

SEQ ID NO: 83748 - DNA, 201 bp, Homo sapiens
gagtcatcagagaaacaatgacagcaatgtgacttccacacctcctgtccccccgcccaggtcctgttgttggtgaatggagctcagttgtgtggggggamcctgatcaacaccatctgggtggtctccgcggcccactgtttcgacaaaatcaagaactggaggaacctgatcgcggtgctgggtgggtaccactctccc

SEQ ID NO: 83749 - DNA, 201 bp, Homo sapiens
acctcctgtccccccgcccaggtcctgttgttggtgaatggagctcagttgtgtggggggaccctgatcaacaccatctgggtggtctccgcggcccactrtttcgacaaaatcaagaactggaggaacctgatcgcggtgctgggtgggtaccactctcccctgtccgaccgcggtgctgggtgggtgccactcttccct

SEQ ID NO: 83750 - DNA, 201 bp, Homo sapiens
cggctatagggcaccctgttccctgcccttccctgtggcacagtttgccccgacacttcctgctgggaacacagagcatagcaactggcagggccgacccrgaccctcctttcccggggccaatgaggccgagctccctgtccgacccggaccctcctttcccgggccgacgaggctgagctccctgtggaacctggccct

SEQ ID NO: 83751 - DNA, 201 bp, Homo sapiens
agtacacatcagacggggtgctgcgaggaaacgggctctccctccccaggggagctcatgtgtccctggacggtgcaagtgtgcatctggcacgcagggcygattgtcacggtggggagggtgccgtgccctgggtgccaggcacagttcttcagtcagtcccgtgcatggggcacagagggtcccgcaatgcggggccac

SEQ ID NO: 83752 - DNA, 201 bp, Homo sapiens
gcaccaggtgggatgtgctcactggttcccaaaacgagaacacatagcagtttccctggatgtttgttcaatactattcccgggacctgcccgtagattcmaattccttatgggtgtggaagagcctggaaatcacgtgtgtgtaggtgtgtggcatgtgtataggggtgtgtttatgtggtgtgactttggggtatgagt

SEQ ID NO: 83753 - DNA, 201 bp, Homo sapiens
acgttctctgagaggacgctggccttcgtgcgcttctcattggtcagcggctggggccagctgctggaccgtggcgccacggccctggagctcatggtccycaacgtgccccggctgatgacccaggactgcctgcagcagtcacggaaggtgggagactccccaaatatcacggagtacatgttctgtgccggctactcg

SEQ ID NO: 83754 - DNA, 201 bp, Homo sapiens
gtggtacgaggccagcttggagaactgtctcagctctctggtcctctcgtcagttgggtctctgattggaaagtcccttggacacttttaccatccccatkggactttcactttcccccaggctcccatcagctgctcggaagagtggtcaccctggaggccactgcccaccagccaggcaccccccaaatgcaaccgcag

SEQ ID NO: 83755 - DNA, 201 bp, Homo sapiens
ggggcctggggagggatttggatctcattctttgtggggtgtggggagtgatcctggctactctgggcaccacagaggcaggagccagtacaggccatcaygtgagggcaggcagcccagtcaccgtcctcttgctccaggccatcatgtgagagcaggtggcccagtcaccgtcctcctgctccaggccatcacgtgagg

SEQ ID NO: 83756 - DNA, 201 bp, Homo sapiens
tgcagcagccattttcttctctaagcagaagagagcccagcaagctggaggaggctgaagagagaggcttcctgctggtcatctgggtccagaatgcctgsagatctctgctcagccctggtgcccagcagccctggtgtgcatcctgcagggcaggccttcccgccggagtcctggacttgctcagggccactccccttg

SEQ ID NO: 83757 - DNA, 201 bp, Homo sapiens
agagtccctgtgtccctgtcccacttccacatcccaccacgcaggaccgcttggtaaacttccccttctctactttccattacaaaggtttgaggggtttkttttttttttaaccatctgaatattaaattatcacaaagtttgaggcccccaacctcccttgggttcagtaattcactagaaggactcatagaatccact

SEQ ID NO: 83758 - DNA, 201 bp, Homo sapiens
gtggcctggccaaccgggctgcagggtgcacaacctggtggggtgtgtaggccgggcattcagggctcagccccagttggaaattggtctaggtgaccttkaaatcccttccagtctgaggtctttgacagggacccaaggttctgattatcagactcagtggccccttgggctcccggccctgggcaattctcagccctc

SEQ ID NO: 83759 - DNA, 201 bp, Homo sapiens
aggcccacatgccacccactaccggggcacgtggtacctgacgggcatcgtcagctggggccagggctgcgcaaccgtgggccactttggggtgtacaccrgggtctcccagtacatcgagtggctgcaaaagctcatgcgctcagagccacgcccaggagtcctcctgcgagccccatttccctagcccagcagccctgg

SEQ ID NO: 83760 - DNA, 201 bp, Homo sapiens
gcttaacaaatgcaaaacaataattcaatttttattcaacatgtacttgtcatgttaggccaactaggagtagaagaaaatttctttaactaaataatatrtatcaaacaaaatctttgcagcgaactttttttttttgtttgtttgtttgtttgttttctgagacggagtctcgctctgtcgcccaggctggagtgcagt

SEQ ID NO: 83761 - DNA, 201 bp, Homo sapiens
tggcatcagggtggcaggagggagctccccggggagcaggtgcgaggggtttgcacctggcatcagggtggcaggagggagctccccggggagcaggtgcsaggggtttgcacctggcatcagggtggcaggagggagctccccggggagcaggtgcgaggggtttgcacctggcatccgggtggcaggagggagctcccc

SEQ ID NO: 83762 - DNA, 201 bp, Homo sapiens
atatctgcttctgcctccctgccttcgagggccggaactgtgagacgcgtaaggccccactttgggtcccatatttgcagagggccctggggagctggtgraggtggcctggccaaccgggctgcagggtgcacaacctggtggggtgtgtaggccgggcattcagggctcagccccagttggaaattggtctaggtgacc

SEQ ID NO: 83763 - DNA, 201 bp, Homo sapiens
ggaaggtgggagactccccaaatatcacggagtacatgttctgtgccggctactcggatggcagcaaggactcctgcaagggggacagtggaggcccacakgccacccactaccggggcacgtggtacctgacgggcatcgtcagctggggccagggctgcgcaaccgtgggccactttggggtgtacaccagggtctccc

SEQ ID NO: 83764 - DNA, 201 bp, Homo sapiens
tgtggggggaccctgatcaacaccatctgggtggtctccgcggcccactgtttcgacaaaatcaagaactggaggaacctgatcgcggtgctgggtgggtrccactctcccctgtccgaccgcggtgctgggtgggtgccactcttccctgtccgaccgcggtgctgggtgggtgccactctcccctgtccgaccgcggtg

SEQ ID NO: 83765 - DNA, 201 bp, Homo sapiens
ggagctcatggtcctcaacgtgccccggctgatgacccaggactgcctgcagcagtcacggaaggtgggagactccccaaatatcacggagtacatgttcbgtgccggctactcggatggcagcaaggactcctgcaagggggacagtggaggcccacatgccacccactaccggggcacgtggtacctgacgggcatcgt

SEQ ID NO: 83766 - DNA, 201 bp, Homo sapiens
taactaaataatatatatcaaacaaaatctttgcagcgaactttttttttttgtttgtttgtttgtttgttttctgagacggagtctcgctctgtcgcccrggctggagtgcagtggcgcgatctcggctcactgcaagctccgcctcccgggttcacaccactctcctgcctcagcctcccgaggagctgggactacagg

SEQ ID NO: 83767 - DNA, 201 bp, Homo sapiens
gggtgggcgtctgttctcatccagcccgtccgggtttaacttagaagtgtgtggcccctcagaagcaggagggtgggcgtctgctctcatccagtccgtcygggtttaacttagaagtgtgtggcccctcagaagcaggagggtgggcgtctgctctcatccagcccgtctgggtttaacttagaagtgtgtggcccctca

SEQ ID NO: 83768 - DNA, 201 bp, Homo sapiens
acaggtcacacctcacacagatcatctcattctcacaggacacctccctctcacaggtcaccttacactcatctcacactcacaggtcgccacacctcacrctcacaggatgcctcacactcacagaaccacatctcatatgcacaagacacctcacactcaggacacctcatgctcaaagaagcctcacactcacaggag

SEQ ID NO: 83769 - DNA, 201 bp, Homo sapiens
ctccccagggagcaggtgcgaggggtttgcacctggcatcagggtggcaggagggagctccccggggagcaggtgcgaggggtttgcacctggcatcaggktggcaggagggagctccccggggagcaggtgcgaggggtttgcacctggcatcagggtggcaggagggagctccccggggagcaggtgcgaggggtttgc

SEQ ID NO: 83770 - DNA, 201 bp, Homo sapiens
tcaccttccgtcccttcttccgcgctcagtaaccaatttaggccgctcctgcagaactcgggctcctgcccaccggcccacagcgtccacctgaggcctcktcctcccagcaaaggtcgtccctccggaacgcgcctcctgcggcctctccagagcccctcccgcgcgtcctctcagccccgctcgcctcctcccggggcc

SEQ ID NO: 83771 - DNA, 201 bp, Homo sapiens
cgcttctcattggtcagcggctggggccagctgctggaccgtggcgccacggccctggagctcatggtcctcaacgtgccccggctgatgacccaggactkcctgcagcagtcacggaaggtgggagactccccaaatatcacggagtacatgttctgtgccggctactcggatggcagcaaggactcctgcaagggggac

SEQ ID NO: 83772 - DNA, 201 bp, Homo sapiens
caaatctctgcatctttctgacttttgttttacacagttgaatatccatgtggaaaaatacctattctagaaaaaagaaatgccagcaaaccccaaggccraattgtggggggcaaggtgtgccccaaaggggagtgtccatggcaggtaaggcttcccctggcttcaggattccaagccctgagggtcttgaagcctttt

SEQ ID NO: 83773 - DNA, 201 bp, Homo sapiens
gaggacgctggccttcgtgcgcttctcattggtcagcggctggggccagctgctggaccgtggcgccacggccctggagctcatggtcctcaacgtgcccyggctgatgacccaggactgcctgcagcagtcacggaaggtgggagactccccaaatatcacggagtacatgttctgtgccggctactcggatggcagcaa

SEQ ID NO: 83774 - DNA, 201 bp, Homo sapiens
ggactgcctgcagcagtcacggaaggtgggagactccccaaatatcacggagtacatgttctgtgccggctactcggatggcagcaaggactcctgcaagrgggacagtggaggcccacatgccacccactaccggggcacgtggtacctgacgggcatcgtcagctggggccagggctgcgcaaccgtgggccactttgg

SEQ ID NO: 83775 - DNA, 201 bp, Homo sapiens
ctctcgctgacccccagaagcccctctcagggtgtccccttcctgtccccagacaaggatgaccagctgatctgtgtgaacgagaacggcggctgtgagcrgtactgcagtgaccacacgggcaccaagcgctcctgtcggtgccacgaggggtactctctgctggcagacggggtgtcctgcacacccacaggtgaccag

SEQ ID NO: 83776 - DNA, 201 bp, Homo sapiens
ccgcgcctcggaccaggacggaggcctggggaaggcggatctggccgccggagacgcggtgcgggtggagacgagggatttggatttccgcgggcggctgyacggatttccacgcgcggttcacgtgggccccaggggggtgcccggcacccggggccgcgccgccttctcctcgccggcatcgacccgcagcctcacgtt

SEQ ID NO: 83777 - DNA, 201 bp, Homo sapiens
ctctgcctgcccgaacggacgttctctgagaggacgctggccttcgtgcgcttctcattggtcagcggctggggccagctgctggaccgtggcgccacggycctggagctcatggtcctcaacgtgccccggctgatgacccaggactgcctgcagcagtcacggaaggtgggagactccccaaatatcacggagtacatg

SEQ ID NO: 83778 - DNA, 201 bp, Homo sapiens
gatggggaccagtgtgcctcaagtccatgccagaatgggggctcctgcaaggaccagctccagtcctatatctgcttctgcctccctgccttcgagggccrgaactgtgagacgcgtaaggccccactttgggtcccatatttgcagagggccctggggagctggtggaggtggcctggccaaccgggctgcagggtgcac

SEQ ID NO: 83779 - DNA, 201 bp, Homo sapiens
aggacgctggccttcgtgcgcttctcattggtcagcggctggggccagctgctggaccgtggcgccacggccctggagctcatggtcctcaacgtgccccrgctgatgacccaggactgcctgcagcagtcacggaaggtgggagactccccaaatatcacggagtacatgttctgtgccggctactcggatggcagcaag

SEQ ID NO: 83780 - DNA, 201 bp, Homo sapiens
agatggggaccagtgtgcctcaagtccatgccagaatgggggctcctgcaaggaccagctccagtcctatatctgcttctgcctccctgccttcgagggcyggaactgtgagacgcgtaaggccccactttgggtcccatatttgcagagggccctggggagctggtggaggtggcctggccaaccgggctgcagggtgca

SEQ ID NO: 83781 - DNA, 201 bp, Homo sapiens
tctcagaggatgggtgtttctgaatctttcctagtggcacgttcatccctcacaaatctctgcatctttctgacttttgttttacacagttgaatatccaygtggaaaaatacctattctagaaaaaagaaatgccagcaaaccccaaggccgaattgtggggggcaaggtgtgccccaaaggggagtgtccatggcaggt

SEQ ID NO: 83782 - DNA, 201 bp, Homo sapiens
ttggtgaatggagctcagttgtgtggggggaccctgatcaacaccatctgggtggtctccgcggcccactgtttcgacaaaatcaagaactggaggaaccygatcgcggtgctgggtgggtaccactctcccctgtccgaccgcggtgctgggtgggtgccactcttccctgtccgaccgcggtgctgggtgggtgccact

SEQ ID NO: 83783 - DNA, 201 bp, Homo sapiens
ggtgcccctctgcctgcccgaacggacgttctctgagaggacgctggccttcgtgcgcttctcattggtcagcggctggggccagctgctggaccgtggcrccacggccctggagctcatggtcctcaacgtgccccggctgatgacccaggactgcctgcagcagtcacggaaggtgggagactccccaaatatcacgga

SEQ ID NO: 83784 - DNA, 201 bp, Homo sapiens
ctcagtggccccttgggctcccggccctgggcaattctcagccctcgagatggcccagctgagagtccctgtgtccctgtcccacttccacatcccaccaygcaggaccgcttggtaaacttccccttctctactttccattacaaaggtttgaggggtttgttttttttttaaccatctgaatattaaattatcacaaag

SEQ ID NO: 83785 - DNA, 201 bp, Homo sapiens
ctaccggggcacgtggtacctgacgggcatcgtcagctggggccagggctgcgcaaccgtgggccactttggggtgtacaccagggtctcccagtacatcragtggctgcaaaagctcatgcgctcagagccacgcccaggagtcctcctgcgagccccatttccctagcccagcagccctggcctgtggagagaaagcca

SEQ ID NO: 83786 - DNA, 201 bp, Homo sapiens
caggcttaagtctgcagagggaccaggcacaagcttccccttgtcctctccctgtggggtcatgtggacagtccttaattctcccagaatgacgtgtgacragacgtgggaagtactgccaacttgggaagctctacgagccccggtgtccagaggttttatcagggctcaatcacatagacccagctgaccacccgcatg

SEQ ID NO: 83787 - DNA, 201 bp, Homo sapiens
tcctgggcatcctgaaggccgtgaacgactccatgcacctcatcgctatcaccggctatgacgtaaggcgcccagatgcccggtcttccccgccgcctccrtggaatacaccagcccagcaacttggcggcctccctgcacacgcccctcgctttggtgtgaatgtgcaggttctgggcaggaggtctggggtggtcccta

SEQ ID NO: 83788 - DNA, 201 bp, Homo sapiens
accttccaagggcttagcggtcatttcccaggagccaaggcaaaggctaccctttctctggcacagcagttcatccttgaccacccaagaccacattcttmcactgaatgagctctcctgtgcagcagccattttcttctctaagcagaagagagcccagcaagctggaggaggctgaagagagaggcttcctgctggtca

SEQ ID NO: 83789 - DNA, 201 bp, Homo sapiens
accgatgcacacgcacatagagatatgcacacacagatgcacacacagatatacacatggatgcacgcacatgccaatgcacgcacacatcagtgcacacrgatgcacagagatatgcacacaccgatgtgcgcacacacagatatgcacacacatggatgagcacacacacaccaatgcgcacacacaccgatgtacaca

SEQ ID NO: 83790 - DNA, 201 bp, Homo sapiens
gaccgcttggtaaacttccccttctctactttccattacaaaggtttgaggggtttgttttttttttaaccatctgaatattaaattatcacaaagtttgrggcccccaacctcccttgggttcagtaattcactagaaggactcatagaatccactgaagtggatacactcacaggtaccgtttattacagcaaaggatg

SEQ ID NO: 83791 - DNA, 201 bp, Homo sapiens
agatgcacacacagatatacacatggatgcacgcacatgccaatgcacgcacacatcagtgcacacggatgcacagagatatgcacacaccgatgtgcgcrcacacagatatgcacacacatggatgagcacacacacaccaatgcgcacacacaccgatgtacacacacagatgcacacacagatgcacacacaccgatg

SEQ ID NO: 83792 - DNA, 201 bp, Homo sapiens
cgcacacacagatatgcacacacatggatgagcacacacacaccaatgcgcacacacaccgatgtacacacacagatgcacacacagatgcacacacaccratgctgactccatgtgtgctgtcctctgaaggcggttgtttagctctcacttttctggttcttatccattatcatcttcacttcagacaattcagaagca

SEQ ID NO: 83793 - DNA, 201 bp, Homo sapiens
ctgggtccagaatgcctggagatctctgctcagccctggtgcccagcagccctggtgtgcatcctgcagggcaggccttcccgccggagtcctggacttgytcagggccactccccttgcccatgtcaaccaaagtcaggctgccggttctgcttcttctgtctgagcccatgaccagtgctgggactaactgtccccagg

SEQ ID NO: 83794 - DNA, 201 bp, Homo sapiens
tgcccccaaactctcccccaaatgtatttctcccttcgctgggtgccgggctgcacagactattccccacctgcttcccagcttcacaataaacggctgcrtctcctccgcacacctgtggtgcctgccacccactgggttgcccatgattcatttttggagcccccggtgctcatcctctgagatgctcttttctttcac

SEQ ID NO: 83795 - DNA, 201 bp, Homo sapiens
tttggagcccccggtgctcatcctctgagatgctcttttctttcacaattttcaacatcactgaaatgaaccctcacatggaagctattttttaaaaacaraagctgtttgatagatgtttgaggctgtagctcccaggatcctgtggaattggatgttctctccctgccacagcccttgtcaatgatatttcacagagac

SEQ ID NO: 83796 - DNA, 201 bp, Homo sapiens
aaaacaaaagctgtttgatagatgtttgaggctgtagctcccaggatcctgtggaattggatgttctctccctgccacagcccttgtcaatgatatttcasagagaccctgggagcacctgctcaagagtcagggacacacgcatcactaaatgcaagttcccaggccctggctgcagtgggaggacctggcaagctgcac

SEQ ID NO: 83797 - DNA, 201 bp, Homo sapiens
tgcaggcttgtagaggtgaggctgtcttcaagcgatcgtttcccgtagcttccgctccaggtgcatttttacctatgttcagagcaaccgcacagtccccscatgcgcaaggtgcctcggcgttgaagtaaagacgctcgttcacgtggtttgtctgctccctcctcgcagaagccagccagcaccgggcgctggagcagt

SEQ ID NO: 83798 - DNA, 201 bp, Homo sapiens
tgtggtcccaagtctggaagaagctccttcctcttctcccgctgggagctgcgtggccgatgggagcccatctccaccgcggcacctgcatggtctcagcsttccggttcggtgccgctgtgccgggggctactctcttgccagtggggaccacagccctcggtatcccataggtcaagggcgtcaggccctctcagtgag

SEQ ID NO: 83799 - DNA, 201 bp, Homo sapiens
gcgccagcctcccttcctgccaatgggaaatgcaggcgcccacctcatggtgctgccggaggagggggcccgggactccccagaggcttcgctgaagggcytgggcgcccccaaaggctacatgtttcatatgggacgtgccacctgccacggctcagctccagctttctgtgagtggcgagatagaatacggggaggcca

SEQ ID NO: 83800 - DNA, 201 bp, Homo sapiens
ggccatgggcctgggacagggtgggatgaggcggcaggcttgggccaccaaagccagcatcgccacccagcattgatgacaaagactgcgtgtctgccatragcatcctgctgttggtgcacacaccgcattggtctctccatacaaacatgcctagaggcgatgtcagagggtggagaccaggagaggcaggagtcagac

SEQ ID NO: 83801 - DNA, 201 bp, Homo sapiens
cacagtgctttcctcctctcccctcacacgcagccacctgacctttgactcctaagattatctttggatgttccgagagtgaaaccaaagcgtgtttcctygggggcctgagtactcacctcctggcgtttcttttggggaaacaggcgccaactcctgagattaaagccgcgtgggtgaatgaaattcggaaagtgctga

SEQ ID NO: 83802 - DNA, 201 bp, Homo sapiens
aggatgggtgtttctgaatctttcctagtggcacgttcatccctcacaaatctctgcatctttctgacttttgttttacacagttgaatatccatgtggaraaatacctattctagaaaaaagaaatgccagcaaaccccaaggccgaattgtggggggcaaggtgtgccccaaaggggagtgtccatggcaggtaaggct

SEQ ID NO: 83803 - DNA, 201 bp, Homo sapiens
tgcagttgggtggggctcagtgagtgcctcctgtgtgccaggcacaatgacgcacaatgtgtgcacaccaggctcatgtgcaggtggctgcgagacagggygacccatcaaggcagatgcaccatgaggcagtggccagtgctgtgggtgttaggggcattgctccccggccactacggcatagcaggcagtgatcgccac

SEQ ID NO: 83804 - DNA, 201 bp, Homo sapiens
gcctctcagaggatgggtgtttctgaatctttcctagtggcacgttcatccctcacaaatctctgcatctttctgacttttgttttacacagttgaatatmcatgtggaaaaatacctattctagaaaaaagaaatgccagcaaaccccaaggccgaattgtggggggcaaggtgtgccccaaaggggagtgtccatggca

SEQ ID NO: 83805 - DNA, 201 bp, Homo sapiens
atagcaggcagtgatcgccacactggccaagctttagaccatttattccagagaccccagaggcaaaaagcccggctgcacctcccagtgactcccacagscattgagcagagacgctcaggaccttgtgatgggaggtttctgcactggagaacgagcccagaagccctctcagcctcggaacagtgtggccagtggtgg

SEQ ID NO: 83806 - DNA, 201 bp, Homo sapiens
atggccttatgaccccggccaccttcctgccccaggcggggtcgctaaggcctcaggaggagaaacacgggacatgccgtggaagccggggcctcacagargtgagcagggactgccactggttttgtcctggggcccagtgggggccaacatcacctccttcccctcccatggcaaagagccagcccgcggggtggctac

SEQ ID NO: 83807 - DNA, 201 bp, Homo sapiens
agctttagaccatttattccagagaccccagaggcaaaaagcccggctgcacctcccagtgactcccacagccattgagcagagacgctcaggaccttgtsatgggaggtttctgcactggagaacgagcccagaagccctctcagcctcggaacagtgtggccagtggtgggcaggtcaggaggggcttcagacacagcc

SEQ ID NO: 83808 - DNA, 201 bp, Homo sapiens
gggcaggtgccagcctggcctgtgggaggccatggtgcagatgccaagcccccccgtgacatgagaccacctgataccacccagagagtggctgtgagcgraagggcccgcccagaaacaagcagggccttggggcagaagtcctgggctcagatcccacgctcactgccagcggcctcggctcaggcttctgcgctctct

SEQ ID NO: 83809 - DNA, 201 bp, Homo sapiens
ctcccccatccctctgtcacccttggaggcagagaactttgcccgtcagtcccatggggaatgtcaacaggcaggggcagcactgcagagatttcatcatsgtctcccaggccctcaggctcctctgccttctgcttgggcttcagggctgcctggctgcaggtgcgtccggggaggttttctccataaacttggtggaag

SEQ ID NO: 83810 - DNA, 201 bp, Homo sapiens
cagcgtggtcactcccctgcctcgccagcaggtctcggctccaatcaggaggcctaagccaagtgataagcagccagacaacagccatcccagctggggcrtggactttgctccagcagcctgtcccagtgaggacagggacacagtactcggccacaccatggggcgcccactgcacctcgtcctgctcagtgcctccct

SEQ ID NO: 83811 - DNA, 201 bp, Homo sapiens
ctcgccagcaggtctcggctccaatcaggaggcctaagccaagtgataagcagccagacaacagccatcccagctggggcgtggactttgctccagcagcytgtcccagtgaggacagggacacagtactcggccacaccatggggcgcccactgcacctcgtcctgctcagtgcctccctggctggcctcctgctgctcg

SEQ ID NO: 83812 - DNA, 201 bp, Homo sapiens
agtgataagcagccagacaacagccatcccagctggggcgtggactttgctccagcagcctgtcccagtgaggacagggacacagtactcggccacaccarggggcgcccactgcacctcgtcctgctcagtgcctccctggctggcctcctgctgctcggggaaagtcgtaagtgcccctcgcccttcagacccaaaagc

SEQ ID NO: 83813 - DNA, 201 bp, Homo sapiens
gaagaggaggcccctctggtggggacacgagagacagggaccctagacttgtttgcatcctggacaaagtggacaggcaggggcaccaaggggacccaggmctgggaagggaatgtgtgagggagagacggagcagggggagaccctcgtggggtggaaaggggagacccctgggaaggctgagtggatcctcagtgcatc

SEQ ID NO: 83814 - DNA, 201 bp, Homo sapiens
agcgagcacgacggggatgagcagagccggcgggtggcgcaggtcatcatccccagcacgtacgtcccgggcaccaccaaccacgacatcgcgctgctccrcctgcaccagcccgtggtcctcactgaccatgtggtgcccctctgcctgcccgaacggacgttctctgagaggacgctggccttcgtgcgcttctcattg

SEQ ID NO: 83815 - DNA, 201 bp, Homo sapiens
atttttattcaacatgtacttgtcatgttaggccaactaggagtagaagaaaatttctttaactaaataatatatatcaaacaaaatctttgcagcgaactttttttttttgtttgtttgtttgtttgttttctgagacggagtctcgctctgtcgcccaggctggagtgcagtggcgcgatctcggctcactgcaagctc

SEQ ID NO: 83816 - DNA, 201 bp, Homo sapiens
agctcccaggatcctgtggaattggatgttctctccctgccacagcccttgtcaatgatatttcacagagaccctgggagcacctgctcaagagtcagggrcacacgcatcactaaatgcaagttcccaggccctggctgcagtgggaggacctggcaagctgcactcttgctgagtccccagggtggtggaagaagaatg

SEQ ID NO: 83817 - DNA, 201 bp, Homo sapiens
tcgcccaggctggagtgcagtggcgcgatctcggctcactgcaagctccgcctcccgggttcacaccactctcctgcctcagcctcccgaggagctgggaytacaggcgcccgccaccacgcccggctcattttttgtatttttagtagagacggggtttcactgcgttagccgggatggtctcgatctcctgacctcgtg

SEQ ID NO: 83818 - DNA, 201 bp, Homo sapiens
gagaaacacatgaacagagaaatggggaggtgacaaacagtgcccccactcagactccggcaagcacggctcagagagtggactcgatgccatccctgcarggccgtcctgggcaccactggcactcacagcagcaaggtgggcaccattggcactcacagcagcaaggcaggcaccagcaacccacctcgggggcactca

SEQ ID NO: 83819 - DNA, 201 bp, Homo sapiens
acgcagccacctgacctttgactcctaagattatctttggatgttccgagagtgaaaccaaagcgtgtttcctcgggggcctgagtactcacctcctggcytttcttttggggaaacaggcgccaactcctgagattaaagccgcgtgggtgaatgaaattcggaaagtgctgaccagccagctgcaggcttgtagaggtg

SEQ ID NO: 83820 - DNA, 201 bp, Homo sapiens
gggtgtccccttcctgtccccagacaaggatgaccagctgatctgtgtgaacgagaacggcggctgtgagcagtactgcagtgaccacacgggcaccaagygctcctgtcggtgccacgaggggtactctctgctggcagacggggtgtcctgcacacccacaggtgaccaggcttcatgtcccagtcccagatgacacca

SEQ ID NO: 83821 - DNA, 201 bp, Homo sapiens
accagcaacccacctcgggggcactcaggcatcatctacttcagagcagacagggtctatgaactacagccgtgggctgcttccaaggcaccctgctcttrtaaataaagttttatgggaacacacccatattagtgtccatggagtggccgtggcagagacgtccagccggacagaccagctgacccgccaagcccagca

SEQ ID NO: 83822 - DNA, 201 bp, Homo sapiens
gcgctgctccgcctgcaccagcccgtggtcctcactgaccatgtggtgcccctctgcctgcccgaacggacgttctctgagaggacgctggccttcgtgcrcttctcattggtcagcggctggggccagctgctggaccgtggcgccacggccctggagctcatggtcctcaacgtgccccggctgatgacccaggactgc

SEQ ID NO: 83823 - DNA, 201 bp, Homo sapiens
gtccccaggcgggctcacggtggtacgaggccagcttggagaactgtctcagctctctggtcctctcgtcagttgggtctctgattggaaagtcccttggrcacttttaccatccccattggactttcactttcccccaggctcccatcagctgctcggaagagtggtcaccctggaggccactgcccaccagccaggcac

SEQ ID NO: 83824 - DNA, 201 bp, Homo sapiens
caccaagggtggcacaggccagagcgacagtgactaggatgggcaccctgggggcaatccctgaatggcctcaggccccctgccaattctaggcagaccargggagccaagcaaggcactatctcacgtccaactcccactcgcaggacctccgccagggttcatgaatctacttcggcacagccaatgtctgtactgact

SEQ ID NO: 83825 - DNA, 201 bp, Homo sapiens
caaaagcagggacaccccacacccactgtgtctcaaagaggcggacgtgcccaccctggccacacagcctgggactcagcctgccacctcctcgggcttcytttctggcccaagaccttgattgaagcagatcaaaactaagcatgggatcaaaacaacacagtttgattcatctttaggtagaatttcattcaccttcta

SEQ ID NO: 83826 - DNA, 201 bp, Homo sapiens
acacccactgtgtctcaaagaggcggacgtgcccaccctggccacacagcctgggactcagcctgccacctcctcgggcttcctttctggcccaagacctygattgaagcagatcaaaactaagcatgggatcaaaacaacacagtttgattcatctttaggtagaatttcattcaccttctactaaagtcaaacaacaca

SEQ ID NO: 83827 - DNA, 201 bp, Homo sapiens
tggcatcagggtggcaggagggagctccccggggagcaggtgcgaggggtttgcacctggcatccgggtggcaggagggagctccccggggagcaggtgcsaggggtttgcacctggcatccgggtggcaggagggagctccccggggagcaggtgccaagggtctgcacctggcaggggtgctgccccatctgcagcacc

SEQ ID NO: 83828 - DNA, 201 bp, Homo sapiens
gaccctggccagaccccggttcctaatgccccctaaacgggacgggagccagtggcgggccctgatccaggtcagagctggctctgctttctcttttgtcygagtgaccatgcctcagtttcctcatctgtaaaacaggagcccaccgtgatgcttatggtgggatgagatcagcatggatggaacaaggccctggaaggg

SEQ ID NO: 83829 - DNA, 201 bp, Homo sapiens
cggggtcctggtggagcgccagcctcccttcctgccaatgggaaatgcaggcgcccacctcatggtgctgccggaggagggggcccgggactccccagagscttcgctgaagggcctgggcgcccccaaaggctacatgtttcatatgggacgtgccacctgccacggctcagctccagctttctgtgagtggcgagatag

SEQ ID NO: 83830 - DNA, 201 bp, Homo sapiens
tctcacagcaccccgtgagtttaagttcaggtggccaacagtttcttcagcaatcacttttttctgtggagtgcttttgctgtttgtggaatattttgcawctgctactgcaccctctccccgtatgtgtggccaccctgtcagaggtggagctgtggctcagagcctgtgtacctcgtcccaggtccacagctcagcgac

SEQ ID NO: 83831 - DNA, 201 bp, Homo sapiens
gctctccctccccaggggagctcatgtgtccctggacggtgcaagtgtgcatctggcacgcagggccgattgtcacggtggggagggtgccgtgccctggktgccaggcacagttcttcagtcagtcccgtgcatggggcacagagggtcccgcaatgcggggccacccacagtgctttcctcctctcccctcacacgcag

SEQ ID NO: 83832 - DNA, 201 bp, Homo sapiens
tctggccgccggagacgcggtgcgggtggagacgagggatttggatttccgcgggcggctgcacggatttccacgcgcggttcacgtgggccccagggggktgcccggcacccggggccgcgccgccttctcctcgccggcatcgacccgcagcctcacgtttacgcggcggcgcccgcagcccccttcggcccggcttcc

SEQ ID NO: 83833 - DNA, 201 bp, Homo sapiens
cctcccccatccctctgtcacccttggaggcagagaactttgcccgtcagtcccatggggaatgtcaacaggcaggggcagcactgcagagatttcatcarggtctcccaggccctcaggctcctctgccttctgcttgggcttcagggctgcctggctgcaggtgcgtccggggaggttttctccataaacttggtggaa

SEQ ID NO: 83834 - DNA, 201 bp, Homo sapiens
cgattctttggtgtccccgcctgcatcctcagcctccttccaaaccagaccagttctctaggggcgtcgacgtgtgaaactgattttaaagaaaacaggcrgtggcctttctctcggccccacgtggcccagtagcgctcaccttccgtcccttcttccgcgctcagtaaccaatttaggccgctcctgcagaactcgggc

SEQ ID NO: 83835 - DNA, 201 bp, Homo sapiens
gacaggcaggggcaccaaggggacccaggcctgggaagggaatgtgtgagggagagacggagcagggggagaccctcgtggggtggaaaggggagaccccygggaaggctgagtggatcctcagtgcatcactgacctaaacggcccctccgcctggtgacttggagctccagtcacatcacacgggggtcttctccatcc

SEQ ID NO: 83836 - DNA, 201 bp, Homo sapiens
  misc_feature (1)...(201): n = A,T,C or G, or insertion/deletion polymorphism (see Tables 1-2)
agggtgctcccaggctggggagcacaggtaggggacggtgcgtgggggatggcgcctggggcatgggggatggggtgtgggaaacggcatgtggggcgtargggatggggtgtggaggatcgggggtggggatggcgtgtggggtgtgggggatgggccgtgggggggtggggcctgggaaacagcatgtggggcnnnnnn

SEQ ID NO: 83837 - DNA, 201 bp, Homo sapiens
gcaggggcagcactgcagagatttcatcatggtctcccaggccctcaggctcctctgccttctgcttgggcttcagggctgcctggctgcaggtgcgtccrgggaggttttctccataaacttggtggaagggcagtgggcaaatccaggagccagcccgggcttcccaaaccccgcccttgctccggacacccccatcca

SEQ ID NO: 83838 - DNA, 201 bp, Homo sapiens
ctgtcccctgagccacatcttcctgtctcccacgcggaacgggactcccgtcttcatggggtactgtgtggctccaactcgcccagccttcttcctccccstcaggccacactgccccctgcaggagcccactgtgatgcttgtggtgggatgagatcagcgtgggtggaacaaggccctggaaggacccatgccatcatc

SEQ ID NO: 83839 - DNA, 201 bp, Homo sapiens
cccacagctctggaggctggaagttcaaaatcaaggcgtcagcggggctggttcctccagaggctgggagagagtctgctctaggcctgtttcctggcctyggggtgccagcggcctcacagcccatggcttgtgggagcattgctcccatcgctgcctccatcatcgcatggggttctcaccatggctgtttttctgtct

SEQ ID NO: 83840 - DNA, 201 bp, Homo sapiens
tcacctgacctttctcctgtcccccccacttgagctcagtggctgggcagcaggggatgcatggccactggccggccaggtgcagctctcagctggggtgytcagaggacgcctgtgtcctcccctcccccatccctctgtcacccttggaggcagagaactttgcccgtcagtcccatggggaatgtcaacaggcagggg

SEQ ID NO: 83841 - DNA, 201 bp, Homo sapiens
ctgtggctcacctaagaaaccagcctcccttgcaggcaacggcctagctggcctggtctggaggctctcttcaaatatttacatccacacccaagatacgktcttgagatttgactcgcatgattgctatgggacaagttttcatctgcagtttaaatctgtttcccaacttacattaggggtttggaattctagatcgta

SEQ ID NO: 83842 - DNA, 201 bp, Homo sapiens
tctgtggctcacctaagaaaccagcctcccttgcaggcaacggcctagctggcctggtctggaggctctcttcaaatatttacatccacacccaagatacrgtcttgagatttgactcgcatgattgctatgggacaagttttcatctgcagtttaaatctgtttcccaacttacattaggggtttggaattctagatcgt

SEQ ID NO: 83843 - DNA, 201 bp, Homo sapiens
ttcttacaaaagacaagctacactttaagagatggacaaaaagataagatggacaatctgagcacatcccatggtgaatttctctccacgctaagaccccrgacaagggtgaaaagcaggaccaaggcccagagaagaaaaattctgctcaaaatcataactgttcaaccttgcatacattctctctcttaaactgaaagt

SEQ ID NO: 83844 - DNA, 201 bp, Homo sapiens
gcgactgggggcctggacggggagggcacgctggcagccaggccccacaggccagtccctgctgctgtagaggaggcacctgggcccccacccttgctgtstctcagcctcccttgctgggggcagctgcaggtgcactcaggaggccaagctgcaggtctgcaaccggaaaatcacagtcctcaattctcacacagatgc

SEQ ID NO: 83845 - DNA, 201 bp, Homo sapiens
caagtagggtgggcgtctgttctcatccagcccgtccgggtttaacttagaagtgtgtggcccctcagaagcaggagggtgggcgtctgctctcatccagyccgtccgggtttaacttagaagtgtgtggcccctcagaagcaggagggtgggcgtctgctctcatccagcccgtctgggtttaacttagaagtgtgtggc

SEQ ID NO: 83846 - DNA, 201 bp, Homo sapiens
aatcaggagcattggatcaaagctatgtgaagatcctgtgaggtgaacagtgaaatctcacagcgacatttgtattcttgggccgtgcccaagagcacgtmtcggctagagaggggcacagcctcccagagccaggtctgagcagctttgcctgggagggatctgcaaagaccccaggatttcagaaagaaattgtgcaat

SEQ ID NO: 83847 - DNA, 201 bp, Homo sapiens
ttcccagcgtggtcactcccctgcctcgccagcaggtctcggctccaatcaggaggcctaagccaagtgataagcagccagacaacagccatcccagctgrggcgtggactttgctccagcagcctgtcccagtgaggacagggacacagtactcggccacaccatggggcgcccactgcacctcgtcctgctcagtgcct

SEQ ID NO: 83848 - DNA, 201 bp, Homo sapiens
ctcttctgcaagaagagggaggagaatggggaggggtatgagaaagctccctcctacagctacaagcagtccttaaacgtaagtgaggccgggtctgcagyagcacgctcctggccacagaccccgacgggggaagtctgtaactcggtctgaggtggacacgctgacacccagctctcagccttaggtgtaggggtgggg

SEQ ID NO: 83849 - DNA, 201 bp, Homo sapiens
catctggaaactacaaaatgagcacgaaatgatgtttttattcttagaacagaaagtccccacacccgcggccctggtgactgatgaggatgaggttccgmggggcctctctggccgcccagctctgcctggggaaggtggggccagagtggatgtgttcccagcgtggtcactcccctgcctcgccagcaggtctcggct

SEQ ID NO: 83850 - DNA, 201 bp, Homo sapiens
cccggtgtccagaggttttatcagggctcaatcacatagacccagctgaccacccgcatggctgacctcagtctcagcccctccagaggctacgccgatartgcggcccaaggccccaccatacatcacattgtcagctagaccatccagcatggctcaaggcccaggtaaacaccaacattccctcaggcaagaccttcc

SEQ ID NO: 83851 - DNA, 201 bp, Homo sapiens
gaagatcctgtgaggtgaacagtgaaatctcacagcgacatttgtattcttgggccgtgcccaagagcacgtctcggctagagaggggcacagcctcccakagccaggtctgagcagctttgcctgggagggatctgcaaagaccccaggatttcagaaagaaattgtgcaatgccagaggttccttggcatgcccgggag

SEQ ID NO: 83852 - DNA, 201 bp, Homo sapiens
gaccctgatcaacaccatctgggtggtctccgcggcccactgtttcgacaaaatcaagaactggaggaacctgatcgcggtgctgggtgggtaccactctyccctgtccgaccgcggtgctgggtgggtgccactcttccctgtccgaccgcggtgctgggtgggtgccactctcccctgtccgaccgcggtgctgggtgg

SEQ ID NO: 83853 - DNA, 201 bp, Homo sapiens
gcggtgctgggtgggtgccactcttccctgtccgaccgcggtgctgggtgggtgccactctcccctgtccgaccgcggtgctgggtgggtgccactctccsctgtccgaccgcggtgctgggtgggtgccactctccgctgtccgaccgcggtgctgggtgggtaccactctcccctgtctgaccgcagctctcaagtgtc

SEQ ID NO: 83854 - DNA, 201 bp, Homo sapiens
tcaacagaggctgccacaggagagagggaggcctggcctgggaacagagctgtgaccgtgcccttccccagggtaggggctgaaggaccctcccatcctartgacagggccacagcatgtccaaggaggccccagaggaggtcccgggagtcctgggagagcctggttagcctccctgaagggaggaagtggggttttgtg

SEQ ID NO: 83855 - DNA, 201 bp, Homo sapiens
gcaggagggtgggcgtctgctctcatccagcccgtctgggtttaacttagaagtgtgtggcccctcagaagcaggagggtgggcgtctgctctcatccagyccgtctgggtttaacttagaagtgtgtggcccctcagaagcaggagggtgggcgtctgctctcatccagtccgtccgggtttaacttagaaacacgtgca

SEQ ID NO: 83856 - DNA, 201 bp, Homo sapiens
aatcggggcacgccctgtcctcccagctgccagggcacagcatcccttccccacctcaacacccagaccccagattcaccccagttcacttgtccccacaygagccacaggctgccacctggggcaggctggccccaccttggggttagatgcaggtccccttgccccagaaggagactgcagcccctgcagacctagaaa

SEQ ID NO: 83857 - DNA, 201 bp, Homo sapiens
gccttctcaggtgagttccctgcagggtgctgaccttgctggctgcgtgtctctgctccgcctggtggcagaggccgctcagccatcttctggggcatccrctagtgaacagggctgatgggacccttgagacggagacgtctaatgccctgctcacctgcgagagctccatgatgggaaatacatggcggggaaatgggc

SEQ ID NO: 83858 - DNA, 201 bp, Homo sapiens
cagattctggtgctgcaaactctgctagcgcagaactaagaaaacgtccctagagacgggccccgaaaggacgcctctgagtgccgcagcccccactcccrtgccctcccggcccctccttcactgcgcggcccctcggctccctgtgttttgctcacagaagctcctttttcatcggtggaaaggggccacaacgtcggt

SEQ ID NO: 83859 - DNA, 201 bp, Homo sapiens
cggaaggtgggagactccccaaatatcacggagtacatgttctgtgccggctactcggatggcagcaaggactcctgcaagggggacagtggaggcccacrtgccacccactaccggggcacgtggtacctgacgggcatcgtcagctggggccagggctgcgcaaccgtgggccactttggggtgtacaccagggtctcc

SEQ ID NO: 83860 - DNA, 201 bp, Homo sapiens
gtggctgcccactcccaggcactgccgttcccatcatggtcagacctctgcgttttgctgttggcctcccccgcgccctgttccagcacggcgctcttgayggcccgcagagaggctctggggagcactgagcacccacggccagggcagctcaagaatccttttgtgtctctggtggtgccaggggcagagtcgcttggg

SEQ ID NO: 83861 - DNA, 201 bp, Homo sapiens
tggcctggcctgtggctgcccactcccaggcactgccgttcccatcatggtcagacctctgcgttttgctgttggcctcccccgcgccctgttccagcacrgcgctcttgacggcccgcagagaggctctggggagcactgagcacccacggccagggcagctcaagaatccttttgtgtctctggtggtgccaggggcag

SEQ ID NO: 83862 - DNA, 201 bp, Homo sapiens
tgcagggtctcgagaaagccagtgtggtgttgaagccgggccactgcccgtgggtcatttccaccgtggtcagtgtggtgtcaaagccgggccactgcccrtgggtcatttccaccgtggccagtgtggtgtcgaagccgggccactgcctgtgggtcatttccaccgtggccagtgtggcgtcgaagccgggccactgcc

SEQ ID NO: 83863 - DNA, 201 bp, Homo sapiens
gcctcatacttcagagcaagtagggtgggcgtctgttctcatccagcccgtccgggtttaacttagaagtgtgtggcccctcagaagcaggagggtgggcrtctgctctcatccagtccgtccgggtttaacttagaagtgtgtggcccctcagaagcaggagggtgggcgtctgctctcatccagcccgtctgggtttaa

SEQ ID NO: 83864 - DNA, 201 bp, Homo sapiens
gggtgggcgtctgctctcatccagcccgtctgggtttaacttagaagtgtgtggcccctcagaagcaggagggtgggcgtctgctctcatccagtccgtcygggtttaacttagaagtgtgtggcccctcagaagcaggagggtgggcgtctgctctcatccagtccgtccgggtttaacttagaaacacgtgcaggagat

SEQ ID NO: 83865 - DNA, 201 bp, Homo sapiens
gccacgcaaaagcgtttctttccacccaatcacgtgttccctgatgctgtgtctcgcgcacagacaccagagttatttagaggtggctttccttcgggaaratgaaggcgagcttttcaaatggaggcttgctcagaaacggagctgtccttggctttccaggccccctccttcctctccctgccccccacccccgccttc

SEQ ID NO: 83866 - DNA, 201 bp, Homo sapiens
gcaggagggtgggcgtctgctctcatccagtccgtctgggtttaacttagaagtgtgtggcccctcagaagcaggagggtgggcgtctgctctcatccagyccgtccgggtttaacttagaaacacgtgcaggagatgctgctttaggatcaggccgggagctcagagatatctgaatgcctcaggtcctcagggcgttct

SEQ ID NO: 83867 - DNA, 201 bp, Homo sapiens
acatcagacggggtgctgcgaggaaacgggctctccctccccaggggagctcatgtgtccctggacggtgcaagtgtgcatctggcacgcagggccgattstcacggtggggagggtgccgtgccctgggtgccaggcacagttcttcagtcagtcccgtgcatggggcacagagggtcccgcaatgcggggccacccaca

SEQ ID NO: 83868 - DNA, 201 bp, Homo sapiens
ggctgcagccctagctcacagcatggccttatgaccccggccaccttcctgccccaggcggggtcgctaaggcctcaggaggagaaacacgggacatgccrtggaagccggggcctcacagaggtgagcagggactgccactggttttgtcctggggcccagtgggggccaacatcacctccttcccctcccatggcaaag

SEQ ID NO: 83869 - DNA, 201 bp, Homo sapiens
gctacaagcagtccttaaacgtaagtgaggccgggtctgcagcagcacgctcctggccacagaccccgacgggggaagtctgtaactcggtctgaggtggmcacgctgacacccagctctcagccttaggtgtaggggtggggtattctgccattcttagccctcacccccaaagtatttccatcatttcgtgcctgcacc

SEQ ID NO: 83870 - DNA, 201 bp, Homo sapiens
ccctgaaaagtgagcagagggcggttttaagacgtaagccctctgtttcctccaaaaccagccctgaccattgtctcctcagccagccacttcttcaaggrcctctcatggccgggccccaccagtcaggcccagccgaggccctgccttccaccacccctgggccctgggagctcctgctcctgggggcctcccatagcc

SEQ ID NO: 83871 - DNA, 201 bp, Homo sapiens
ctgccacacatggtgaactagcgctgatgctgattagtgactgagggccgttccccttggagctcactctgggtgctgtgcattctgcggtttggacaggygtgtaacatcctacacccagcgctagagcatcacacagagcagcttcactgtcctagaagcccatgtgccccgccagtccatccctcctcccccagcccc

SEQ ID NO: 83872 - DNA, 201 bp, Homo sapiens
cgggtggcaggagggagctccccggggagcaggtgcgaggggtttgcacctggcatccgggtggcaggagggagctccccggggagcaggtgccaagggtytgcacctggcaggggtgctgccccatctgcagcaccactcagtctgtcccagctgcaggagggcaggcagggcagctccccacagaccaggggagggtga

SEQ ID NO: 83873 - DNA, 201 bp, Homo sapiens
aggagactgcagcccctgcagacctagaaatggccacagcccatccccatgcaccagggggtgaggtggcaggtggtggaaagggcctgaggggggcttcytccttccaggcgagcacgacctcagcgagcacgacggggatgagcagagccggcgggtggcgcaggtcatcatccccagcacgtacgtcccgggcaccac

SEQ ID NO: 83874 - DNA, 201 bp, Homo sapiens
cctgtcccagtgaggacagggacacagtactcggccacaccatggggcgcccactgcacctcgtcctgctcagtgcctccctggctggcctcctgctgctyggggaaagtcgtaagtgcccctcgcccttcagacccaaaagcagcgccagggagcagggaggggcggcagttggggaaaccctctcatctctgcagcctg

SEQ ID NO: 83875 - DNA, 201 bp, Homo sapiens
gggattaggggtgcttctggcaggtccacccaggcttgggtcttaggacacagccccagctcctcctaaccctggaaggtccacatgggcctgggtcttamgggcagtgccagctcctcctaactctctctggaaggtccacccagacctgggtcttggggcacagccccagctcctcctaactctctctggaaggtccac

SEQ ID NO: 83876 - DNA, 201 bp, Homo sapiens
gcggcctcggcgccggagacccgcgcgctgtctggggctgcggtggcgtggggagggcgcggcccccggacgccccgaggaaggggcacctcaccgccccsacccagagcgcctggccgtgcgggctgcagaggacccctccggggcagaggcaggttccacggaaaaccccggcccgctggggcttccccggagactcca

SEQ ID NO: 83877 - DNA, 201 bp, Homo sapiens
ggttgtgcgtgtcagaaacgcaaaggcagcagaggaagcgtagtggaaccattacagaatcacaatgcagccgacactctccagaccagaaaagggagcayaaagaaagggtattgatccaatagaagaagggaagggtggagaaaggggaaagcatggttaacaggaaacaacatgtaacggaagagacagcccagatgt

SEQ ID NO: 83878 - DNA, 201 bp, Homo sapiens
ctgcctcagcctcccgaggagctgggactacaggcgcccgccaccacgcccggctcattttttgtatttttagtagagacggggtttcactgcgttagccrggatggtctcgatctcctgacctcgtgatctcccacctcagcctcccaaagtgctgggattacaggcgtgagccaccgcgcccggctgcagcaaaaattt

SEQ ID NO: 83879 - DNA, 201 bp, Homo sapiens
agaggaggtcccgggagtcctgggagagcctggttagcctccctgaagggaggaagtggggttttgtgagagggatggtgcagcagcccccacacctgctrctccgtgtggccgggtccagccccaggcaaggttccaggcatgcccctgggacagacgtgggagggagaccagcaggcaggtccccctcagggaggtatg

SEQ ID NO: 83880 - DNA, 201 bp, Homo sapiens
ctgacccccagaagcccctctcagggtgtccccttcctgtccccagacaaggatgaccagctgatctgtgtgaacgagaacggcggctgtgagcagtactrcagtgaccacacgggcaccaagcgctcctgtcggtgccacgaggggtactctctgctggcagacggggtgtcctgcacacccacaggtgaccaggcttca

SEQ ID NO: 83881 - DNA, 201 bp, Homo sapiens
tgacttccacacctcctgtccccccgcccaggtcctgttgttggtgaatggagctcagttgtgtggggggaccctgatcaacaccatctgggtggtctccrcggcccactgtttcgacaaaatcaagaactggaggaacctgatcgcggtgctgggtgggtaccactctcccctgtccgaccgcggtgctgggtgggtgcc

SEQ ID NO: 83882 - DNA, 201 bp, Homo sapiens
atttctttaactaaataatatatatcaaacaaaatctttgcagcgaactttttttttttgtttgtttgtttgtttgttttctgagacggagtctcgctctktcgcccaggctggagtgcagtggcgcgatctcggctcactgcaagctccgcctcccgggttcacaccactctcctgcctcagcctcccgaggagctggga

SEQ ID NO: 83883 - DNA, 201 bp, Homo sapiens
aacggacgttctctgagaggacgctggccttcgtgcgcttctcattggtcagcggctggggccagctgctggaccgtggcgccacggccctggagctcatrgtcctcaacgtgccccggctgatgacccaggactgcctgcagcagtcacggaaggtgggagactccccaaatatcacggagtacatgttctgtgccggct

SEQ ID NO: 83884 - DNA, 201 bp, Homo sapiens
gggtgggcgtctgctctcatccagtccgtctgggtttaacttagaagtgtgtggcccctcagaagcaggagggtgggcgtctgctctcatccagtccgtcygggtttaacttagaaacacgtgcaggagatgctgctttaggatcaggccgggagctcagagatatctgaatgcctcaggtcctcagggcgttctgaaaga

SEQ ID NO: 83885 - DNA, 201 bp, Homo sapiens
atcacggagtacatgttctgtgccggctactcggatggcagcaaggactcctgcaagggggacagtggaggcccacatgccacccactaccggggcacgtrgtacctgacgggcatcgtcagctggggccagggctgcgcaaccgtgggccactttggggtgtacaccagggtctcccagtacatcgagtggctgcaaaag

SEQ ID NO: 83886 - DNA, 201 bp, Homo sapiens
tgaagacagtacagccttgcagggtctcgagaaagccagtgtggtgttgaagccgggccactgcccgtgggtcatttccaccgtggtcagtgtggtgtcaragccgggccactgcccatgggtcatttccaccgtggccagtgtggtgtcgaagccgggccactgcctgtgggtcatttccaccgtggccagtgtggcgtc

SEQ ID NO: 83887 - DNA, 201 bp, Homo sapiens
aattaacgttcttttctacaaaaaaaatgcagggacttgatttttttaaagagcttcactgaattaggatatttttattgcttttaaagaaaatacaaagwtgcagtttctgcagggtgtggcgtggaccagtgctgccgaccatagctcagagagccctgcccctgcctcactgcactgcagcctcctcggaggccgcac

SEQ ID NO: 83888 - DNA, 201 bp, Homo sapiens
gacgctgtcagccattggaactggcctgcaagacagcttgctgtggcggctttgcaggcacagggcacacaggcatccgtgcacgcagctcctctgtcctcccatgccccacaccctccatcgcaaggaaacgcttgcttccagtggtaccaaataggatttggaaccagtttgtgcccaagctcaaatctcgttagcatc

SEQ ID NO: 83889 - DNA, 201 bp, Homo sapiens
aaatctcgttagcatctgcctgtttccctggtgtgcatgtgtcctgcctcgatgcatttggcagcaggtgggatgcgctgggcctgctgcctggttgctgsctttgcgtgtttatttagccccaatggcgtctcccatctcccccgcatgggaaaggccggtgctgccctctgggagcctggcaggaggaacactgggttg

SEQ ID NO: 83890 - DNA, 201 bp, Homo sapiens
tttttattcaacatgtacttgtcatgttaggccaactaggagtagaagaaaatttctttaactaaataatatatatcaaacaaaatctttgcagcgaactttttttttttgtttgtttgtttgtttgttttctgagacggagtctcgctctgtcgcccaggctggagtgcagtggcgcgatctcggctcactgcaagctcc

SEQ ID NO: 83891 - DNA, 201 bp, Homo sapiens
ttttattcaacatgtacttgtcatgttaggccaactaggagtagaagaaaatttctttaactaaataatatatatcaaacaaaatctttgcagcgaactttttttttttgtttgtttgtttgtttgttttctgagacggagtctcgctctgtcgcccaggctggagtgcagtggcgcgatctcggctcactgcaagctccg

SEQ ID NO: 83892 - DNA, 201 bp, Homo sapiens
tgatgtactgtgcaggcgcggtgcctccgtctcgtcgcacagctgcgcgcccttgtgtgaccctccccataaaggcactttacagcttcatgtttcatccmctgtcacttttttttaactgctgatgtaaatggaattttaaaagcagagttctttattgtatggatgacgtttgaataaatatcagcaactcctgccatc

SEQ ID NO: 83893 - DNA, 201 bp, Homo sapiens
ttcaacatgtacttgtcatgttaggccaactaggagtagaagaaaatttctttaactaaataatatatatcaaacaaaatctttgcagcgaactttttttktttgtttgtttgtttgtttgttttctgagacggagtctcgctctgtcgcccaggctggagtgcagtggcgcgatctcggctcactgcaagctccgcctcc

SEQ ID NO: 83894 - DNA, 201 bp, Homo sapiens
aagcaaatttatatatagattggagatttaaaataaaagaagacagaacagacaaacaccataagaaagctggtgtagcagtatcgatgacctgaaatggrattcaggacagttcatagagtaaagggggctgcgtggcaatcaggaactcataagccactgactataaagctcaaaacacagcaaagttggcagtcggca

SEQ ID NO: 83895 - DNA, 201 bp, Homo sapiens
aatatatatcaaacaaaatctttgcagcgaactttttttttttgtttgtttgtttgtttgttttctgagacggagtctcgctctgtcgcccaggctggagkgcagtggcgcgatctcggctcactgcaagctccgcctcccgggttcacaccactctcctgcctcagcctcccgaggagctgggactacaggcgcccgcca

SEQ ID NO: 83896 - DNA, 201 bp, Homo sapiens
ggctggagtgcagtggcgcgatctcggctcactgcaagctccgcctcccgggttcacaccactctcctgcctcagcctcccgaggagctgggactacaggygcccgccaccacgcccggctcattttttgtatttttagtagagacggggtttcactgcgttagccgggatggtctcgatctcctgacctcgtgatctccc

SEQ ID NO: 83897 - DNA, 201 bp, Homo sapiens
cgtggtcctcactgaccatgtggtgcccctctgcctgcccgaacggacgttctctgagaggacgctggccttcgtgcgcttctcattggtcagcggctggrgccagctgctggaccgtggcgccacggccctggagctcatggtcctcaacgtgccccggctgatgacccaggactgcctgcagcagtcacggaaggtggg

SEQ ID NO: 83898 - DNA, 201 bp, Homo sapiens
agggatttggatttccgcgggcggctgcacggatttccacgcgcggttcacgtgggccccaggggggtgcccggcacccggggccgcgccgccttctcctsgccggcatcgacccgcagcctcacgtttacgcggcggcgcccgcagcccccttcggcccggcttccgcgcgtgcccccgagcgcgccctcgggatcagcc

SEQ ID NO: 83899 - DNA, 201 bp, Homo sapiens
ggacacctcacactcacaggtcaccttactctcacaggacacctcacacagggcacacttcactcccacaggtcaccatacctcacacagatcacctcatwctcacagatcacttcattctcacaggatacctcacactcagggcacacttcacactcacaggtcacacctcacacagatcatctcattctcacaggacac

SEQ ID NO: 83900 - DNA, 201 bp, Homo sapiens
actctccagaccagaaaagggagcataaagaaagggtattgatccaatagaagaagggaagggtggagaaaggggaaagcatggttaacaggaaacaacaygtaacggaagagacagcccagatgtgtctggctcacaacagacgtgatcatgttatgctggcctggaagagcatcggatcagacgtgacaagtcactgct

SEQ ID NO: 83901 - DNA, 201 bp, Homo sapiens
gcccgcagcccccttcggcccggcttccgcgcgtgcccccgagcgcgccctcgggatcagcccccggaagcagagaggccaggccgggaaggatgggcgamgggggtggctgacccgggagcacggcagggaggacacccagccaggcccgcgagcagcgccgctcccctcctccaggacgggcgggaacctgcgatgccc

SEQ ID NO: 83902 - DNA, 201 bp, Homo sapiens
aagcatggttaacaggaaacaacatgtaacggaagagacagcccagatgtgtctggctcacaacagacgtgatcatgttatgctggcctggaagagcatcrgatcagacgtgacaagtcactgcttagagaccatcaagcaaatttatatatagattggagatttaaaataaaagaagacagaacagacaaacaccataag

SEQ ID NO: 83903 - DNA, 201 bp, Homo sapiens
gaaatcccttccagtctgaggtctttgacagggacccaaggttctgattatcagactcagtggccccttgggctcccggccctgggcaattctcagccctsgagatggcccagctgagagtccctgtgtccctgtcccacttccacatcccaccacgcaggaccgcttggtaaacttccccttctctactttccattacaa

SEQ ID NO: 83904 - DNA, 201 bp, Homo sapiens
ggccctggagctcatggtcctcaacgtgccccggctgatgacccaggactgcctgcagcagtcacggaaggtgggagactccccaaatatcacggagtacrtgttctgtgccggctactcggatggcagcaaggactcctgcaagggggacagtggaggcccacatgccacccactaccggggcacgtggtacctgacggg

SEQ ID NO: 83905 - DNA, 201 bp, Homo sapiens
agggtggcaggagggagctccccggggagcaggtgcgaggggtttgcacctggcatccgggtggcaggagggagctccccggggagcaggtgcgaggggtytgcacctggcatccgggtggcaggagggagctccccggggagcaggtgccaagggtctgcacctggcaggggtgctgccccatctgcagcaccactcagt

SEQ ID NO: 83906 - DNA, 201 bp, Homo sapiens
tctcatccagtccgtccgggtttaacttagaaacacgtgcaggagatgctgctttaggatcaggccgggagctcagagatatctgaatgcctcaggtcctmagggcgttctgaaagactaaccaggcaacacactatttcctttttgatttgtctgatgtcatcagtccctcaagaggaaactcaaggaacatcaagaagc

SEQ ID NO: 83907 - DNA, 201 bp, Homo sapiens
cacctcacactcacagggcacacttcacactcacgggtcacctcacactccaagatcacctcaaagaggacacctcacacagggcacacttcacactcacrggtcacctcacactcacaggacacctcacactcacagggcacacttcacactcacgggtcacctcacactccaagatcacctcaaagaggacacctcaca

SEQ ID NO: 83908 - DNA, 201 bp, Homo sapiens
gcacctgcatggtctcagccttccggttcggtgccgctgtgccgggggctactctcttgccagtggggaccacagccctcggtatcccataggtcaagggmgtcaggccctctcagtgagcttcagtcattcactttagaaactgcttcccggctcggtctgctaggtgttgaacatgaccgtggcactcactgaaaacac

SEQ ID NO: 83909 - DNA, 201 bp, Homo sapiens
ggtcacctcacacccacaggacacctcacacagggcacacttcacactcacgggtcacctcacactcacaggacacctcacacaagacacctcacacgggrcacacttcacactcacaggtcacctcacacccacaggacacctcacacagggcacacttcacactcacgggtcacctcacactcacaggacacctcacac

SEQ ID NO: 83910 - DNA, 201 bp, Homo sapiens
ggtgcaaaggggacaggtcccggaggctctggaagggcagagaagccaggcgtggaagggtggggagagccctcggggcctctggcctctcccacagagasagcatgaaggaaggcctgggcgtgagaacagatgtgggggacacagaggcggaggccacgtggcaggaggggaaacaggctggtggaacagggtgcacgg

SEQ ID NO: 83911 - DNA, 201 bp, Homo sapiens
cccataaaggcactttacagcttcatgtttcatccactgtcacttttttttaactgctgatgtaaatggaattttaaaagcagagttctttattgtatggrtgacgtttgaataaatatcagcaactcctgccatctgcctttgtctgtcaagacacagaacgtctcagcggtcggggtttccagggccgcagtgcactgt

SEQ ID NO: 83912 - DNA, 201 bp, Homo sapiens
acgccttccatcgccgctgcggtagtcatgccctgcggcgtagcctcctcccaaggctggagcccttccccggagctggtcgtggccaggagctcccaccrgggcagggcgctaaggcccggcactccgcctggctgctgtggggctgctgccggggcgggtgctgacgctgtctgtgcccctgcccgtctcccaccaggt

SEQ ID NO: 83913 - DNA, 201 bp, Homo sapiens
agctgcctccagctgtggccccaagaaggcaaagcacccgggtggggtggagggagcagccccgtgctctactggctgacagtggtgcccaggcccagctsccttctctgcacagacagcagagttccgcttagcacaggcttttcctcgccagtgcacacactgtcagccattggaactggcctgcaagacagcttgctg

SEQ ID NO: 83914 - DNA, 201 bp, Homo sapiens
taaaaattagccgggcatggtggcacatacctgtagtcccagctacttgggaagctgagaccttacaagtgagcccaggagtccaaggctgcagtgagctrtgatgatcatgccactgcactccagcctgggcaacagagcaagaccctgtctctcaaaatcaaccaaacaaaaagacaatgtaagaaaaaataaaattat

SEQ ID NO: 83915 - DNA, 201 bp, Homo sapiens
tctctgcacagacagcagagttccgcttagcacaggcttttcctcgccagtgcacacactgtcagccattggaactggcctgcaagacagcttgctgtggyggctttgcaggcacagggcacacaggcatccgtgcacgcagctcctctgtcctcccatgccctgcaccctctgtcacaaggaaacccttgcttctaggat

SEQ ID NO: 83916 - DNA, 201 bp, Homo sapiens
atttggcaccaggtgggatgtgctcactggttcccaaaacgagaacacatagcagtttccctggatgtttgttcaatactattcccgggacctgcccgtakattccaattccttatgggtgtggaagagcctggaaatcacgtgtgtgtaggtgtgtggcatgtgtataggggtgtgtttatgtggtgtgactttggggta

SEQ ID NO: 83917 - DNA, 201 bp, Homo sapiens
aactggcctgcaagacagcttgctgtggcggctttgcaggcacagggcacacaggcatccgtgcacgcagctcctctgtcctcccatgccctgcaccctcygtcacaaggaaacccttgcttctaggattgcaccaaataggatttggaaccaattggtgcccaagctcaaatcctgttagtggctgcctgtttccctggc

SEQ ID NO: 83918 - DNA, 201 bp, Homo sapiens
tcagggatggctgcagatgaacaaggtgctgacgtggtttctgtagcccccaaacaagcaacttgccttgagatgacaaccaaagttttcctgtgtcctcyacactcaagagtgactgtgaggcggaggggcccagcccttcttgcaggcgggaatgagtggatgggtggatcaacagaggctgccacaggagagagggag

SEQ ID NO: 83919 - DNA, 201 bp, Homo sapiens
gcctgtaatcccagcactttgggaggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaa

SEQ ID NO: 83920 - DNA, 201 bp, Homo sapiens
cagcactttgggaggctgaggcatgtggatcacttgaggtcaggagttcgaaaccagcctggtcaacacggtgaaaccccatctctgctaaaaaaaaaaawaaatatatatatatatatatatataaattagccaggcatggtgacgtgcacctgtggtcccagctactcaggaggctgaggcacaagaatcacttgaacc

SEQ ID NO: 83921 - DNA, 201 bp, Homo sapiens
actttgggaggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaatcacttgaacccggg

SEQ ID NO: 83922 - DNA, 201 bp, Homo sapiens
ggttattggggttttccttgaggcccctggtgtttatgtgctgacgggtccgtcccagagggtgtacttcacagatgtgtgcctccgacaatgcccagtcyctctccagctcttcccggggtgggctgttccacagcacggcagtgcgcacatggcctgtccagatcacagccacgccccagcactcctcagacagtcggg

SEQ ID NO: 83923 - DNA, 201 bp, Homo sapiens
tttgggaggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaatcacttgaacccgggag

SEQ ID NO: 83924 - DNA, 201 bp, Homo sapiens
tgggaggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaatcacttgaacccgggaggt

SEQ ID NO: 83925 - DNA, 201 bp, Homo sapiens
agggggtgaggtggcaggtggtggaaagggcctgaggggggcttcttccttccaggcgagcacgacctcagcgagcacgacggggatgagcagagccggcrggtggcgcaggtcatcatccccagcacgtacgtcccgggcaccaccaaccacgacatcgcgctgctccgcctgcaccagcccgtggtcctcactgaccat

SEQ ID NO: 83926 - DNA, 201 bp, Homo sapiens
ggaggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaatcacttgaacccgggaggtgg

SEQ ID NO: 83927 - DNA, 201 bp, Homo sapiens
aggctgaggcatgtggatcacttgaggtcaggagttcgaaaccagcctggtcaacacggtgaaaccccatctctgctaaaaaaaaaaaaaaatatatatatatatatatatataaattagccaggcatggtgacgtgcacctgtggtcccagctactcaggaggctgaggcacaagaatcacttgaacccgggaggtggag

SEQ ID NO: 83928 - DNA, 201 bp, Homo sapiens
attcactagaaggactcatagaatccactgaagtggatacactcacaggtaccgtttattacagcaaaggatgcaggcttaagtctgcagagggaccaggsacaagcttccccttgtcctctccctgtggggtcatgtggacagtccttaattctcccagaatgacgtgtgacgagacgtgggaagtactgccaacttggg

SEQ ID NO: 83929 - DNA, 201 bp, Homo sapiens
cccagtcttcgtaacccaggaggaagcccacggcgtcctgcaccggcgccggcgcgccaacgcgttcctggaggagctgcggccgggctccctggagaggragtgcaaggaggagcagtgctccttcgaggaggcccgggagatcttcaaggacgcggagaggacggtgagcccagcctcggggcgccccgcgccgcggac

SEQ ID NO: 83930 - DNA, 201 bp, Homo sapiens; identical to SEQ ID NO: 64497

SEQ ID NO: 83931 - DNA, 201 bp, Homo sapiens; identical to SEQ ID NO: 64501

SEQ ID NO: 83932 - DNA, 201 bp, Homo sapiens; identical to SEQ ID NO: 83402

SEQ ID NO: 83933 - DNA, 201 bp, Homo sapiens
gtctgtcattccagctatcgcaaggctgaggcaggaagatagcttgagctcaggggttgaagacaatcctggacaacatagtgggactctgtctccaaagaaaaaagagagagagagagagagagagagagagggagagagagagagagagagggagagaagtaagaaaggctggaggtgggagcagaactcacagggaag

SEQ ID NO: 83934 - DNA, 201 bp, Homo sapiens
gcaggaagatagcttgagctcaggggttgaagacaatcctggacaacatagtgggactctgtctccaaagaaaaaagagagagagagagagagagagagagagggagagagagagagagagagggagagaagtaagaaaggctggaggtgggagcagaactcacagggaaggatctgacggcatcgcctcccatcagcacc

SEQ ID NO: 83935 - DNA, 201 bp, Homo sapiens
ggaagatagcttgagctcaggggttgaagacaatcctggacaacatagtgggactctgtctccaaagaaaaaagagagagagagagagagagagagagagrgagagagagagagagagagggagagaagtaagaaaggctggaggtgggagcagaactcacagggaaggatctgacggcatcgcctcccatcagcaccttc

SEQ ID NO: 83936 - DNA, 201 bp, Homo sapiens
catttagttaataatatgcctgatagttaaggtctctcagttcattaaaaacagtttcggccgggtgcagtggctcacgcctataatcccaacactttggraggccaaggcgagtggatcacctgaggtcaggagtttgagaccagcctggccaacatggtgaaacctcgtctctactaaaaatacacaagttagccagca

SEQ ID NO: 83937 - DNA, 201 bp, Homo sapiens; identical to SEQ ID NO: 64511

SEQ ID NO: 83938 - DNA, 201 bp, Homo sapiens; identical to SEQ ID NO: 64512

SEQ ID NO: 83939 - DNA, 201 bp, Homo sapiens
tgaaacccaggaacctgagtccttctcagcctggtcagatcgcctggcccgggaacatgcccagaagtgccagcagcagcagcgagaagcagagggatccygtcgacccccacgtgctgagggctccagccagagctggcgacagcaggaggaggagcagcggctcttcagggagcgagcccgggccaaggaggaagagct

SEQ ID NO: 83940 - DNA, 201 bp, Homo sapiens; identical to SEQ ID NO: 64518

SEQ ID NO: 83941 - DNA, 201 bp, Homo sapiens; identical to SEQ ID NO: 83410

SEQ ID NO: 83942 - DNA, 201 bp, Homo sapiens
tctccgccattcagctgctgccccatcctaaacctgagttcatctctgggcagcccaggcatggccttccctataaacatttccttttccaagaaccagtmgttgaagtcctgagaggtggagggagagtctgggattcccacggaggagagaggggggctccctggaaactaagataggtagaccccactaccatcgccc

SEQ ID NO: 83943 - DNA, 201 bp, Homo sapiens
acaggatcttcaagggagggggcggagtgaccagaagagccctgagcatgatcaaaggaagagaaccaataaaggagaggttggggagcagtcagagaagyagggcacggggggcgggggatgccaagcagagacagggcagccatgtttgaggcttcaaagaggtctagtaaatgagggttgaaaagattgttgggttca

SEQ ID NO: 83944 - DNA, 201 bp, Homo sapiens
ggaagtgagatccacacttgatggccttaagctcaatgaaatattaatagatgagagtgaagaacatcagaggcacggagatttagaacatcacgcacagkagtataatggggagtcaacaaagaatgagtaaaagttgtgtccaagaacactgatgactctctgagattagctggccaggattagttataggcctcttat

SEQ ID NO: 83945 - DNA, 201 bp, Homo sapiens
ggagaagcaagctgattggtgaagctatatttaatttgcatagcaatcaccttgtgtgtgtgtgtgtgtgtgtgtgtgtgtgtgtgtgtgtgtgtgtgtgttgtttggttgggtttttttgttttttgttttttttttgagctggagtctcactctgtcgcccaggctggaatgcagtggcacaatctcggctcactgcaa

SEQ ID NO: 83946 - DNA, 201 bp, Homo sapiens; identical to SEQ ID NO: 64542

SEQ ID NO: 83947 - DNA, 201 bp, Homo sapiens
tgtgtgtgtgtgtgtgtgtgtgtgtgtgtgtgtgtgtgtgtgttgtttggttgggtttttttgttttttgttttttttttgagctggagtctcactctgtygcccaggctggaatgcagtggcacaatctcggctcactgcaacctctgcctcctgggttcaagcaattctcttgcctcagcctcccaagtagctgggatt

SEQ ID NO: 83948 - DNA, 201 bp, Homo sapiens; identical to SEQ ID NO: 83418

SEQ ID NO: 83949 - DNA, 201 bp, Homo sapiens
ctgttttggttttttgagacagggtctggctctgtctcacccaggctggagttcagtggcgccatcacggctcactgcagcctcaacctccagggctcagytgatcctcccacttcagtctcctgagtagctgggactgcaggcgcacaccaccacaccaggctaatttttgtattttttgtagagatggggtctccctgt

SEQ ID NO: 83950 - DNA, 201 bp, Homo sapiens; identical to SEQ ID NO: 64546

SEQ ID NO: 83951 - DNA, 201 bp, Homo sapiens
agggctcagttgatcctcccacttcagtctcctgagtagctgggactgcaggcgcacaccaccacaccaggctaatttttgtattttttgtagagatgggrtctccctgtgttgcccaggccggtatccaactcctgggctcaaacaatccatccacttaggcctcccaaagtgcatgagtcaccatgcctggcgaaatgt

SEQ ID NO: 83952 - DNA, 201 bp, Homo sapiens
gttgcagtgagctgatatcgcaccattgcactccagcctgggcaacaagagcgaaactccgtctcaaaaaaaaaaaaaaaagaaaaagaaaacaacattcrtctctttggacatctccatcagagctcttggataactatgtacattgtcaatgagcagtaatcattttaaagaaatcttgtttttcggagcagtagacct

SEQ ID NO: 83953 - DNA, 201 bp, Homo sapiens
gtacaattattctcatttcaccctatgtttgcactttttaataataaaatgtaaaaaaaacaaaacaaacaaacaaaaaaccctgaatattattcagcatrgggaacatggaggatggggagaagggtgggggaggaagtagaaggttcttgaatttggaaggggaaacgcaaattaatatggacccacccaggcaccaca

SEQ ID NO: 83954 - DNA, 201 bp, Homo sapiens
gtctcctaccagccagcctaaacacaggagccacagtgatcttttaaaaacaagtccaggctgggcgcgttggctatgcctataatcccagcactttgggrggccgaggtgggtggatcacgaggtcaggagttcaagaccagcctgcccaacatgatgaaaccctatctctactaaaaataccaaaattagccaggcacg

SEQ ID NO: 83955 - DNA, 201 bp, Homo sapiens
gtgttgcccaggccggtatccaactcctgggctcaaacaatccatccacttaggcctcccaaagtgcatgagtcaccatgcctggcgaaatgtatttcttraataatgagacttgaaagtctaaattactccttaaaccatggactacaggatggatgttatgttagcaggcaggaaaacaacattcagctgggcgtggtg

SEQ ID NO: 83956 - DNA, 201 bp, Homo sapiens
cagtccatctcgagcctccgttcaaattgatcatcatcaaaacttatgtggctttttgacctttgaatagggaattttttaaattttttaaaaattaaaawaaaaaaaacacatggctcacccttccacccactctggggtcaaatagtaatttattgggtgaatgacagtgttcagggacccaagctcccctaacagcca

SEQ ID NO: 83957 - DNA, 201 bp, Homo sapiens; identical to SEQ ID NO: 64549

SEQ ID NO: 83958 - DNA, 201 bp, Homo sapiens
tggtagggataagatgtggagaaagactgagctagttatacaagttgttaagagcataataaatattttgatggataagattgtgctgtgaagacaggaaragcatggcaaatgcaaaaggcacgtgctttgggagatgaggaggagtttatcagtggtctgggggagagaaaataacgacccctctcttctgccttcatt

SEQ ID NO: 83959 - DNA, 201 bp, Homo sapiens; identical to SEQ ID NO: 64550

SEQ ID NO: 83960 - DNA, 201 bp, Homo sapiens; identical to SEQ ID NO: 64551

SEQ ID NO: 83961 - DNA, 201 bp, Homo sapiens; identical to SEQ ID NO: 64552

SEQ ID NO: 83962 - DNA, 201 bp, Homo sapiens; identical to SEQ ID NO: 64555

SEQ ID NO: 83963 - DNA, 201 bp, Homo sapiens; identical to SEQ ID NO: 64557

SEQ ID NO: 83964 - DNA, 201 bp, Homo sapiens
gaagcccaggagggcagatcacttgagttaaagagttggaggccaggccaggcatggtggctcatgcctgtaatcccagcactttgggaggctgaggcggscggatcacgagttcaggagatcgagaccatcctggctaacacggtgaaaccccatctctactaaaaatacaaaaaattagctgggtgtggtggcatctgc

SEQ ID NO: 83965 - DNA, 201 bp, Homo sapiens
ggacagatgctgctggaggagatgtcagggtctctaggaggccaaggggccagcttgtggcaggctagctaagcgtgtgagggggagggtggggcttagakggctgctaacccaagggtgagtgggcggttgggcgggtgagaccaggatgtgggttcccccaccttccgaggttcaaggagaccagcttttacccagaac

SEQ ID NO: 83966 - DNA, 201 bp, Homo sapiens; identical to SEQ ID NO: 64562

SEQ ID NO: 83967 - DNA, 201 bp, Homo sapiens
tccaagatttctatgagggattaggagaagcaagctgattggtgaagctatatttaatttgcatagcaatcaccttgtgtgtgtgtgtgtgtgtgtgtgtrtgtgtgtgtgtgtgtgtgtgtgttgtttggttgggtttttttgttttttgttttttttttgagctggagtctcactctgtcgcccaggctggaatgcagt

SEQ ID NO: 83968 - DNA, 201 bp, Homo sapiens
tagtcctgttgtttctacccctggaatgtataatatatcccaaacttgtctacttctctccatctccatggctgccactattttctcttcaccatcaatgycactgccacctgtctcctaccagccagcctaaacacaggagccacagtgatcttttaaaaacaagtccaggctgggcgcgttggctatgcctataatccc

SEQ ID NO: 83969 - DNA, 201 bp, Homo sapiens
cgggtggattgcttgagctcaggagttcaagaccagcctaggcaacatagcaaaaccctatctctggaaaaaaaaaaaaaatacaaaacttagccgggcayggtggtatgcgcctgtagtcctagctactcaggaggctgacgtgggaggatcacttgagcccaggaggtcgaggctgcagtgagccaagatcacgccact

SEQ ID NO: 83970 - DNA, 201 bp, Homo sapiens; identical to SEQ ID NO: 64567

SEQ ID NO: 83971 - DNA, 201 bp, Homo sapiens; identical to SEQ ID NO: 64568

SEQ ID NO: 83972 - DNA, 201 bp, Homo sapiens
ctcctccacccaggagatttctcactggtttttaagcacatcatttccccttctgcaagagttacataaaaccaaagcaaaataagccctgaaacctgggyccaccggaccacagtcttttcaacgtcccttcctggtgtctggcccccagccctggtgggggttcccctgagataagggctgttcactttctctgaccac

SEQ ID NO: 83973 - DNA, 201 bp, Homo sapiens; identical to SEQ ID NO: 83431

SEQ ID NO: 83974 - DNA, 201 bp, Homo sapiens
ttccccttctgcaagagttacataaaaccaaagcaaaataagccctgaaacctgggcccaccggaccacagtcttttcaacgtcccttcctggtgtctggmccccagccctggtgggggttcccctgagataagggctgttcactttctctgaccacatggtttccgcttctgtgtctcttgtttcctaggctgataaaaa

SEQ ID NO: 83975 - DNA, 201 bp, Homo sapiens; identical to SEQ ID NO: 64569

SEQ ID NO: 83976 - DNA, 201 bp, Homo sapiens; identical to SEQ ID NO: 64571

SEQ ID NO: 83977 - DNA, 201 bp, Homo sapiens; identical to SEQ ID NO: 64570

SEQ ID NO: 83978 - DNA, 201 bp, Homo sapiens; identical to SEQ ID NO: 64578

SEQ ID NO: 83979 - DNA, 201 bp, Homo sapiens; identical to SEQ ID NO: 64582

SEQ ID NO: 83980 - DNA, 201 bp, Homo sapiens; identical to SEQ ID NO: 64580

SEQ ID NO: 83981 - DNA, 201 bp, Homo sapiens
taaaaaatgttaatagagccaggtgcagtggcccactcctgtaattccagcactttggaaggctaaggtggaaagattgcttgagaccaggagttcaaaaycagcctgggcaacatagtaagaccccatttctacaaagcctcatgtggtagctggtgtctgtagtcctagctactcagaaggctaaggtgggaggacctc

SEQ ID NO: 83982 - DNA, 201 bp, Homo sapiens; identical to SEQ ID NO: 64593

SEQ ID NO: 83983 - DNA, 201 bp, Homo sapiens
cagccagaagagggtatgtgtgggcctggcaggaaagggcagttgccaaggaggagtcatatctgatccttcccatttctcaggacaatcaggctcagccycctgggactgggggaagcagatgtgctgagctcccacatggtggtgggaggggcgctgggaccacagccggcagctgccttcttggacctttccaggtca

SEQ ID NO: 83984 - DNA, 201 bp, Homo sapiens; identical to SEQ ID NO: 83450

SEQ ID NO: 83985 - DNA, 201 bp, Homo sapiens; identical to SEQ ID NO: 64598

SEQ ID NO: 83986 - DNA, 201 bp, Homo sapiens; identical to SEQ ID NO: 83452

SEQ ID NO: 83987 - DNA, 201 bp, Homo sapiens; identical to SEQ ID NO: 83454

SEQ ID NO: 83988 - DNA, 201 bp, Homo sapiens; identical to SEQ ID NO: 83456

SEQ ID NO: 83989 - DNA, 201 bp, Homo sapiens; identical to SEQ ID NO: 83457

SEQ ID NO: 83990 - DNA, 201 bp, Homo sapiens
atggggagcttcctatgacacacgggactcacacatcacttgccaaggaccacaactgccagggacctcgagcatcaaatgcttgcctccctgaggagagrggacagatgctgctggaggagatgtcagggtctctaggaggccaaggggccagcttgtggcaggctagctaagcgtgtgagggggagggtggggcttaga

SEQ ID NO: 83991 - DNA, 201 bp, Homo sapiens; identical to SEQ ID NO: 64607

SEQ ID NO: 83992 - DNA, 201 bp, Homo sapiens; identical to SEQ ID NO: 64608

SEQ ID NO: 83993 - DNA, 201 bp, Homo sapiens; identical to SEQ ID NO: 64610

SEQ ID NO: 83994 - DNA, 201 bp, Homo sapiens; identical to SEQ ID NO: 64499

SEQ ID NO: 83995 - DNA, 201 bp, Homo sapiens; identical to SEQ ID NO: 64510

SEQ ID NO: 83996 - DNA, 201 bp, Homo sapiens
tgaaagcatgatccgggacgtggagctggccgaggaggcgctccccaagaagacaggggggccccagggctccaggcggtgcttgttcctcagcctcttcyccttcctgatcgtggcaggcgccaccacgctcttctgcctgctgcactttggagtgatcggcccccagagggaagaggtgagtgcctggccagccttcat

SEQ ID NO: 83997 - DNA, 201 bp, Homo sapiens; identical to SEQ ID NO: 64520

SEQ ID NO: 83998 - DNA, 201 bp, Homo sapiens; identical to SEQ ID NO: 64522

SEQ ID NO: 83999 - DNA, 201 bp, Homo sapiens; identical to SEQ ID NO: 64524

SEQ ID NO: 84000 - DNA, 201 bp, Homo sapiens; identical to SEQ ID NO: 64527

SEQ ID NO: 84001 - DNA, 201 bp, Homo sapiens; identical to SEQ ID NO: 64528

SEQ ID NO: 84002 - DNA, 201 bp, Homo sapiens
ggacacaactgggaacttggcaaaaagaaaggacagggctgcaaggagagtacagacatgtgctggtgagtgcactgtctgcatagttacaccagagcatsttatcaatcagaaacttatctttcaggttttgagcccagttctctacaggagaatcccaggagtggaagtggaaggcagtagaagacagggagggcacgc

SEQ ID NO: 84003 - DNA, 201 bp, Homo sapiens; identical to SEQ ID NO: 64530

SEQ ID NO: 84004 - DNA, 201 bp, Homo sapiens; identical to SEQ ID NO: 64531

SEQ ID NO: 84005 - DNA, 201 bp, Homo sapiens
accacatggtttccgcttctgtgtctcttgtttcctaggctgataaaaatactgagccctagaggccctggcttcctctgaccccttggggcaggcagcasgcatcctgtccagcatggtgggggcagggacaggggccagggattcccaaggggtgactcagtgcctgccatgaaacagtgggtaggtggaagtgtatct

SEQ ID NO: 84006 - DNA, 201 bp, Homo sapiens; identical to SEQ ID NO: 64532

SEQ ID NO: 84007 - DNA, 201 bp, Homo sapiens; identical to SEQ ID NO: 64533

SEQ ID NO: 84008 - DNA, 201 bp, Homo sapiens; identical to SEQ ID NO: 64536

SEQ ID NO: 84009 - DNA, 201 bp, Homo sapiens; identical to SEQ ID NO: 64535

SEQ ID NO: 84010 - DNA, 201 bp, Homo sapiens; identical to SEQ ID NO: 64538

SEQ ID NO: 84011 - DNA, 201 bp, Homo sapiens; identical to SEQ ID NO: 64540

SEQ ID NO: 84012 - DNA, 201 bp, Homo sapiens; identical to SEQ ID NO: 64543

SEQ ID NO: 84013 - DNA, 201 bp, Homo sapiens; identical to SEQ ID NO: 64545

SEQ ID NO: 84014 - DNA, 201 bp, Homo sapiens; identical to SEQ ID NO: 83490

SEQ ID NO: 84015 - DNA, 201 bp, Homo sapiens; identical to SEQ ID NO: 64547

SEQ ID NO: 84016 - DNA, 201 bp, Homo sapiens; identical to SEQ ID NO: 64548

SEQ ID NO: 84017 - DNA, 201 bp, Homo sapiens
ttttagacagttattatctgatcctctctctctctctcttttttttttttttttttttttttgagatagagtctcaccctgtcacccaggctggaatgcaraggcgcgatctcggctcactgcaacctccgcctcccaggttcaagcagttctctgcctcaacctcccaagtagctgggattacaggcgtcagccaccacg

SEQ ID NO: 84018 - DNA, 201 bp, Homo sapiens; identical to SEQ ID NO: 64553

SEQ ID NO: 84019 - DNA, 201 bp, Homo sapiens; identical to SEQ ID NO: 64554

SEQ ID NO: 84020 - DNA, 201 bp, Homo sapiens; identical to SEQ ID NO: 64556

SEQ ID NO: 84021 - DNA, 201 bp, Homo sapiens; identical to SEQ ID NO: 64558

SEQ ID NO: 84022 - DNA, 201 bp, Homo sapiens
aataaaaaatgttaatagagccaggtgcagtggcccactcctgtaattccagcactttggaaggctaaggtggaaagattgcttgagaccaggagttcaaratcagcctgggcaacatagtaagaccccatttctacaaagcctcatgtggtagctggtgtctgtagtcctagctactcagaaggctaaggtgggaggacc

SEQ ID NO: 84023 - DNA, 201 bp, Homo sapiens; identical to SEQ ID NO: 64559

SEQ ID NO: 84024 - DNA, 201 bp, Homo sapiens; identical to SEQ ID NO: 83499

SEQ ID NO: 84025 - DNA, 201 bp, Homo sapiens; identical to SEQ ID NO: 83500

SEQ ID NO: 84026 - DNA, 201 bp, Homo sapiens; identical to SEQ ID NO: 83501

SEQ ID NO: 84027 - DNA, 201 bp, Homo sapiens; identical to SEQ ID NO: 83503

SEQ ID NO: 84028 - DNA, 201 bp, Homo sapiens; identical to SEQ ID NO: 83504

SEQ ID NO: 84029 - DNA, 201 bp, Homo sapiens
aacatgggttgtctgttcttgggcaactggagctccacacccaaagccagccaggctgctggctccatccatctctgccctctagcttgtcagttgtatcyctcttcctccagggccccaatcctcatctccgccattcagctgctgccccatcctaaacctgagttcatctctgggcagcccaggcatggccttccctat

SEQ ID NO: 84030 - DNA, 201 bp, Homo sapiens; identical to SEQ ID NO: 83505

SEQ ID NO: 84031 - DNA, 201 bp, Homo sapiens
caccagcctcgccctcccaaagtgctgggattcctgttttggttttttgagacagggtctggctctgtctcacccaggctggagttcagtggcgccatcayggctcactgcagcctcaacctccagggctcagttgatcctcccacttcagtctcctgagtagctgggactgcaggcgcacaccaccacaccaggctaatt

SEQ ID NO: 84032 - DNA, 201 bp, Homo sapiens
ctttgggaggatcacttgaggccaggagttcgagaccagcctggccaacatggtgaaaccccgtctctactaaaaatataaaaactagctgggtgtggtgktgggcacctgtaatcccagctactcaggtgtctgaggcacaagaatcacttgaacccgggaggcagaggttgcagtgagctgagatcatgcctctgctct

SEQ ID NO: 84033 - DNA, 201 bp, Homo sapiens
cttagtttacccaagtcaatttttgagacagagtttcactcttgttgcccaggctggagtgcaatggctcaatcttggttccctgcaacctctgcctcccrggttcaagcgattctcctccctcagcctccagagtagctgggattacagttgcccaccatcacgcccagctaatttttgtatttttagtagagatggggc

SEQ ID NO: 84034 - DNA, 201 bp, Homo sapiens
atcacgaggtcaggagttcaagaccagcctgcccaacatgatgaaaccctatctctactaaaaataccaaaattagccaggcacggtggcgcatgcctgtwatcccagctactcggggggccgaggcaagagaatcacttgaacctgggaggtggaagttgcagtgagccaagatcatgccgtagcactccaacctgggca

SEQ ID NO: 84035 - DNA, 201 bp, Homo sapiens
tagtcccagctactcaggaggctgaggcaggagaatcacctgaacatgggaggcagaggttgcagtgagccaaaatcgcaccacggcactccagccaggcracagagcgagactcagtctcaaaaaaaaaaaaaaaaaagtttcaccaagaaatttatcatagatttacttggatctctcaaactaaaaagcctcacagtg

SEQ ID NO: 84036 - DNA, 201 bp, Homo sapiens; identical to SEQ ID NO: 83508

SEQ ID NO: 84037 - DNA, 201 bp, Homo sapiens; identical to SEQ ID NO: 83509

SEQ ID NO: 84038 - DNA, 201 bp, Homo sapiens; identical to SEQ ID NO: 83510

SEQ ID NO: 84039 - DNA, 201 bp, Homo sapiens; identical to SEQ ID NO: 64573

SEQ ID NO: 84040 - DNA, 201 bp, Homo sapiens; identical to SEQ ID NO: 83512

SEQ ID NO: 84041 - DNA, 201 bp, Homo sapiens; identical to SEQ ID NO: 83513

SEQ ID NO: 84042 - DNA, 201 bp, Homo sapiens; identical to SEQ ID NO: 64576

SEQ ID NO: 84043 - DNA, 201 bp, Homo sapiens; identical to SEQ ID NO: 83515

SEQ ID NO: 84044 - DNA, 201 bp, Homo sapiens; identical to SEQ ID NO: 83516

SEQ ID NO: 84045 - DNA, 201 bp, Homo sapiens; identical to SEQ ID NO: 83517

SEQ ID NO: 84046 - DNA, 201 bp, Homo sapiens; identical to SEQ ID NO: 83518

SEQ ID NO: 84047 - DNA, 201 bp, Homo sapiens
ctcccaagtagctgggattacaggcgtcagccaccacgcctggctaattttatatataatataaaatataattatatatatattttgtttgtttgttttartaaagacgggttttcaccatcttggccaggctggtattgaactcctgaccttgtgatccattgtccccccccccagcctcccaaagtgctgggattacag

SEQ ID NO: 84048 - DNA, 201 bp, Homo sapiens; identical to SEQ ID NO: 83519

SEQ ID NO: 84049 - DNA, 201 bp, Homo sapiens
gctaaccttgggccagatgcagcaaggttgggactgaagaaaaggggagttcaggaacgtcggttcctctcctgttttctctcagcccatgggtgagaccytctgtcacactccactccctttcccctgccctaggtcagcagtcatttggaaagagcttgctctgccgccggccatagttgttgccggttcacctcccca

SEQ ID NO: 84050 - DNA, 201 bp, Homo sapiens
taaccttgggccagatgcagcaaggttgggactgaagaaaaggggagttcaggaacgtcggttcctctcctgttttctctcagcccatgggtgagaccctytgtcacactccactccctttcccctgccctaggtcagcagtcatttggaaagagcttgctctgccgccggccatagttgttgccggttcacctccccacc

SEQ ID NO: 84051 - DNA, 201 bp, Homo sapiens
ctgccgagtagctgggactgcaggcgcccgccaccaggcctggctaattttttgtattttttagtagagatgggatttcaccatgttagccaggatggtcktgatctcctgacctcgtgatccgcccgcctcggactcccaaagtgctgggattacaggcgtgagccaccgcgcctggccgagaatattttaaactaccac

SEQ ID NO: 84052 - DNA, 201 bp, Homo sapiens
gccatccttcctctttttcttttttctttttttgagatggggtcttgctctgttgcccaggctggaatgcagtggtgcaatcttggctcactgcaaactcygtcccctgggttcaagcgatcctggtgcctcagcctcccaagtagctgggactacaggcacccaccaccacgactggctaatttttgtattttcagtcga

SEQ ID NO: 84053 - DNA, 201 bp, Homo sapiens
tgtatttttagtagagacagggtttcaccatgttggccaggctggtctcgaactcctgacctcaggtgatccacccgcctcagcctcccaaagtgctgggrttacaggccatgagccaccacgcccggcctctttttttccaaccataggatttggtctcttgttttagacagttattatctgatcctctctctctctctc

SEQ ID NO: 84054 - DNA, 201 bp, Homo sapiens; identical to SEQ ID NO: 64601

SEQ ID NO: 84055 - DNA, 201 bp, Homo sapiens; identical to SEQ ID NO: 64602

SEQ ID NO: 84056 - DNA, 201 bp, Homo sapiens
cttgagctcaggagttcaagaccagcctaggcaacatagcaaaaccctatctctggaaaaaaaaaaaaaatacaaaacttagccgggcacggtggtatgcrcctgtagtcctagctactcaggaggctgacgtgggaggatcacttgagcccaggaggtcgaggctgcagtgagccaagatcacgccactgcactccagcc

SEQ ID NO: 84057 - DNA, 201 bp, Homo sapiens; identical to SEQ ID NO: 64604

SEQ ID NO: 84058 - DNA, 201 bp, Homo sapiens; identical to SEQ ID NO: 64605

SEQ ID NO: 84059 - DNA, 201 bp, Homo sapiens; identical to SEQ ID NO: 83525

SEQ ID NO: 84060 - DNA, 201 bp, Homo sapiens; identical to SEQ ID NO: 83527

SEQ ID NO: 84061 - DNA, 201 bp, Homo sapiens
agcctctgcatgccccctcagttcagccctaagaaggcccagtttgccatccagtctcactccactccctacactggggtcttgtccaccctgcaatctgyggctggagaaatagatgcgaacagaggcaaaaaggggaacaaaaccagtttccctcccctccctggctccccaagctgaaccacatcctcctccccactt

SEQ ID NO: 84062 - DNA, 201 bp, Homo sapiens
cttgtagccaggcctttggtcaccagatggggatggggagcttcctatgacacacgggactcacacatcacttgccaaggaccacaactgccagggacctygagcatcaaatgcttgcctccctgaggagagaggacagatgctgctggaggagatgtcagggtctctaggaggccaaggggccagcttgtggcaggctag

SEQ ID NO: 84063 - DNA, 201 bp, Homo sapiens; identical to SEQ ID NO: 83529

SEQ ID NO: 84064 - DNA, 201 bp, Homo sapiens
actctgttcagtgtaggtcaactgagcattatgtagcccaaagataaatttaaaccctgcttcaagcttacaatctagtggggaggcagacccatacctarttaactgattcaaggcatgatgagtaaactttaagatgattacagaaagaggggagattaagtccatttgaaagcatccagggagcctctgaggagacag

SEQ ID NO: 84065 - DNA, 201 bp, Homo sapiens
ccacctcccagcatctcacctttctccaccaccagccgagtcccattccctgtcccgacaccaaggcccagcacctccactctgcacacgtagatgctggygtcatggcctcgcacgtcccggatgtgcagctcagcctggtggtcatggaggaaacgggaagaagcaagtggggccaggcggcccctgaactctggggtt

SEQ ID NO: 84066 - DNA, 201 bp, Homo sapiens
aggatgtgggttcccccaccttccgaggttcaaggagaccagcttttacccagaacaagcctccaggagccctccttggcccagaagctaacctacttacyctccctgctgctcaccagtacccagacccatcccacccattcccttcctggaatctggcctcactgcaccccagggctactccaagatttctatgaggga

SEQ ID NO: 84067 - DNA, 201 bp, Homo sapiens; identical to SEQ ID NO: 64498

SEQ ID NO: 84068 - DNA, 201 bp, Homo sapiens; identical to SEQ ID NO: 64500

SEQ ID NO: 84069 - DNA, 201 bp, Homo sapiens; identical to SEQ ID NO: 64502

SEQ ID NO: 84070 - DNA, 201 bp, Homo sapiens; identical to SEQ ID NO: 64503

SEQ ID NO: 84071 - DNA, 201 bp, Homo sapiens; identical to SEQ ID NO: 64504

SEQ ID NO: 84072 - DNA, 201 bp, Homo sapiens; identical to SEQ ID NO: 64506

SEQ ID NO: 84073 - DNA, 201 bp, Homo sapiens; identical to SEQ ID NO: 64508

SEQ ID NO: 84074 - DNA, 201 bp, Homo sapiens; identical to SEQ ID NO: 64534

SEQ ID NO: 84075 - DNA, 201 bp, Homo sapiens; identical to SEQ ID NO: 64537

SEQ ID NO: 84076 - DNA, 201 bp, Homo sapiens
ggcagccagctgttcctcctttaagggtgactccctcgatgttaaccattctccttctccccaacagttccccagggacctctctctaatcagccctctgycccaggcagtcagtaagtgtctccaaacctctttcctaattctgggtttgggtttgggggtagggttagtaccggtatggaagcagtgggggaaatttaa

SEQ ID NO: 84077 - DNA, 201 bp, Homo sapiens; identical to SEQ ID NO: 64541

SEQ ID NO: 84078 - DNA, 201 bp, Homo sapiens
ggaaacgggaagaagcaagtggggccaggcggcccctgaactctggggttccattcctcacctccttccctggaaccacctcatctcggaaccacgtgacrgagccaatggccagtctcccttggctggcattgaaggagcagggcaggaaggcagaggatccttccagggtacgaatctcagggggctgggacacccaga

SEQ ID NO: 84079 - DNA, 201 bp, Homo sapiens; identical to SEQ ID NO: 83416

SEQ ID NO: 84080 - DNA, 201 bp, Homo sapiens; identical to SEQ ID NO: 64544

SEQ ID NO: 84081 - DNA, 201 bp, Homo sapiens
tggagttcagtggcgccatcacggctcactgcagcctcaacctccagggctcagttgatcctcccacttcagtctcctgagtagctgggactgcaggcgcrcaccaccacaccaggctaatttttgtattttttgtagagatggggtctccctgtgttgcccaggccggtatccaactcctgggctcaaacaatccatcca

SEQ ID NO: 84082 - DNA, 201 bp, Homo sapiens
tctgtcctccctcctcccactctcttactgcccctcccatcccgtccactattgcccctggctccattactcacatttgccctggtaatagacggtgctgrccacggccacagagagaaagctgacagcatagaatccagcccgaaggaggaggactgtaccagcccctagctgaggatgttctgcatggggcaatggaga

SEQ ID NO: 84083 - DNA, 201 bp, Homo sapiens
agccagcctaaacacaggagccacagtgatcttttaaaaacaagtccaggctgggcgcgttggctatgcctataatcccagcactttgggaggccgaggtrggtggatcacgaggtcaggagttcaagaccagcctgcccaacatgatgaaaccctatctctactaaaaataccaaaattagccaggcacggtggcgcatg

SEQ ID NO: 84084 - DNA, 201 bp, Homo sapiens
agcccctagctgaggatgttctgcatggggcaatggagacgggggttggggaagaagtgcacacaggctcagggagggaaggggcctcagaggagcatccytgcctcccaaggacattgcctcttggggcctccagccaggaggagacaccacctcccagcatctcacctttctccaccaccagccgagtcccattccctg

SEQ ID NO: 84085 - DNA, 201 bp, Homo sapiens
ccatgatcaagatgagcaacagcatccaggccatgtcggaagatgtcccagttggcgaaggggatctgagcagtgaggtctgggtggaggaggaaggactyactacttgtagccaggcctttggtcaccagatggggatggggagcttcctatgacacacgggactcacacatcacttgccaaggaccacaactgccaggg

SEQ ID NO: 84086 - DNA, 201 bp, Homo sapiens
ccatctgaggagtggcagtgtgttcccatgtgacagtggcctggtcagagagaggacaggagctgctcagtgttgcagtcccgaggctctcctcttcctgrtctctgtcctccctcctcccactctcttactgcccctcccatcccgtccactattgcccctggctccattactcacatttgccctggtaatagacggtgc

SEQ ID NO: 84087 - DNA, 201 bp, Homo sapiens
atgtgctgagctcccacatggtggtgggaggggcgctgggaccacagccggcagctgccttcttggacctttccaggtcagacctggtggaagggaaagtrcagagttgggggaatccggagagagtagatttggcatctggagaatggagaagaaaacacttgagactcatgaggagttagtggtggggcagatttattg

SEQ ID NO: 84088 - DNA, 201 bp, Homo sapiens
ccatttctcaggacaatcaggctcagcctcctgggactgggggaagcagatgtgctgagctcccacatggtggtgggaggggcgctgggaccacagccggyagctgccttcttggacctttccaggtcagacctggtggaagggaaagttcagagttgggggaatccggagagagtagatttggcatctggagaatggaga

SEQ ID NO: 84089 - DNA, 201 bp, Homo sapiens
ctcaggacaatcaggctcagcctcctgggactgggggaagcagatgtgctgagctcccacatggtggtgggaggggcgctgggaccacagccggcagctgmcttcttggacctttccaggtcagacctggtggaagggaaagttcagagttgggggaatccggagagagtagatttggcatctggagaatggagaagaaaa

SEQ ID NO: 84090 - DNA, 201 bp, Homo sapiens
cgagaccagcctggccaacatggtgaaaccccgtctctactaaaaatataaaaactagctgggtgtggtgttgggcacctgtaatcccagctactcaggtrtctgaggcacaagaatcacttgaacccgggaggcagaggttgcagtgagctgagatcatgcctctgctctccagtctgggtgacagagcaagactctgta

SEQ ID NO: 84091 - DNA, 201 bp, Homo sapiens; identical to SEQ ID NO: 64564

SEQ ID NO: 84092 - DNA, 201 bp, Homo sapiens
ttatttcctaatacccaggaggcatccatgtgagccacccttccattgctttaagaccaagggagcgagtgaccagcaggattcaagatggcagctctgcygaggagtgggagtcccagctaacttctgctccctgctctcccaccaacagcctacaccgatttcttcctcccgctgctaagccgctgtccctccgccatg

SEQ ID NO: 84093 - DNA, 201 bp, Homo sapiens; identical to SEQ ID NO: 64565

SEQ ID NO: 84094 - DNA, 201 bp, Homo sapiens; identical to SEQ ID NO: 64566

SEQ ID NO: 84095 - DNA, 201 bp, Homo sapiens; identical to SEQ ID NO: 64572

SEQ ID NO: 84096 - DNA, 201 bp, Homo sapiens; identical to SEQ ID NO: 64574

SEQ ID NO: 84097 - DNA, 201 bp, Homo sapiens; identical to SEQ ID NO: 64587

SEQ ID NO: 84098 - DNA, 201 bp, Homo sapiens; identical to SEQ ID NO: 64588

SEQ ID NO: 84099 - DNA, 201 bp, Homo sapiens; identical to SEQ ID NO: 64589

SEQ ID NO: 84100 - DNA, 201 bp, Homo sapiens; identical to SEQ ID NO: 13091

SEQ ID NO: 84101 - DNA, 201 bp, Homo sapiens; identical to SEQ ID NO: 13092

SEQ ID NO: 84102 - DNA, 201 bp, Homo sapiens; identical to SEQ ID NO: 13095

SEQ ID NO: 84103 - DNA, 201 bp, Homo sapiens
gtggtaagaatatgttcactgtacaattattctcatttcaccctatgtttgcactttttaataataaaatgtaaaaaaaacaaaacaaacaaacaaaaaamcctgaatattattcagcatggggaacatggaggatggggagaagggtgggggaggaagtagaaggttcttgaatttggaaggggaaacgcaaattaatat

SEQ ID NO: 84104 - DNA, 201 bp, Homo sapiens
agtccatctcgagcctccgttcaaattgatcatcatcaaaacttatgtggctttttgacctttgaatagggaattttttaaattttttaaaaattaaaatwaaaaaaacacatggctcacccttccacccactctggggtcaaatagtaatttattgggtgaatgacagtgttcagggacccaagctcccctaacagccag

SEQ ID NO: 84105 - DNA, 201 bp, Homo sapiens; identical to SEQ ID NO: 13096

SEQ ID NO: 84106 - DNA, 201 bp, Homo sapiens; identical to SEQ ID NO: 64595

SEQ ID NO: 84107 - DNA, 201 bp, Homo sapiens
gcgggtggacagggtccccctgtggtccagccagtaaaaaccatggtccccccacttctgtgtctcagtcctctcagtccatctcgagcctccgttcaaawtgatcatcatcaaaacttatgtggctttttgacctttgaatagggaattttttaaattttttaaaaattaaaataaaaaaaacacatggctcacccttcc

SEQ ID NO: 84108 - DNA, 201 bp, Homo sapiens; identical to SEQ ID NO: 64596

SEQ ID NO: 84109 - DNA, 201 bp, Homo sapiens
aggactagagttcctgacctccaggccagtccctgatccctgacctaatgttatcgcggaatgatggtaagtaaagtgtctcttgcatctgcatagagagrgtcctgggagcttaggaagtgatggggaacagtgatgtatgcagctcatgactaggtggacaggcctctggggacagctggtacaggagggaaagggacc

SEQ ID NO: 84110 - DNA, 201 bp, Homo sapiens; identical to SEQ ID NO: 64597

SEQ ID NO: 84111 - DNA, 201 bp, Homo sapiens
ccacaccagccaagggggcccccacactcccgcgctgctctgcggctcagggagcagcccacctgctgggtgtgctgatatcaccctcccttcttcccccyagtgcccacacccacccaggcccaggctccttcccctccatcatccccttaccagcacctagaaccatccagggctgaaaagtcccctccaaaccacgtg

SEQ ID NO: 84112 - DNA, 201 bp, Homo sapiens; identical to SEQ ID NO: 83449

SEQ ID NO: 84113 - DNA, 201 bp, Homo sapiens; identical to SEQ ID NO: 64599

SEQ ID NO: 84114 - DNA, 201 bp, Homo sapiens; identical to SEQ ID NO: 64600
  misc_feature (1)...(201): n = A,T,C or G, or insertion/deletion polymorphism (see Tables 1-2)

SEQ ID NO: 84115 - DNA, 201 bp, Homo sapiens
actttgggaggatcacttgaggccaggagttcgagaccagcctggccaacatggtgaaaccccgtctctactaaaaatataaaaactagctgggtgtggtsttgggcacctgtaatcccagctactcaggtgtctgaggcacaagaatcacttgaacccgggaggcagaggttgcagtgagctgagatcatgcctctgctc

SEQ ID NO: 84116 - DNA, 201 bp, Homo sapiens
aatgatggtaagtaaagtgtctcttgcatctgcatagagagagtcctgggagcttaggaagtgatggggaacagtgatgtatgcagctcatgactaggtgracaggcctctggggacagctggtacaggagggaaagggacctcacgggaggcccagaaacctggtaagaggtgaggtattaaggtctgggatggagaagc

SEQ ID NO: 84117 - DNA, 201 bp, Homo sapiens; identical to SEQ ID NO: 83458

SEQ ID NO: 84118 - DNA, 201 bp, Homo sapiens
ttgataaatatgtgataaagcaaataaaaaatgttaatagagccaggtgcagtggcccactcctgtaattccagcactttggaaggctaaggtggaaagaytgcttgagaccaggagttcaaaatcagcctgggcaacatagtaagaccccatttctacaaagcctcatgtggtagctggtgtctgtagtcctagctactc

SEQ ID NO: 84119 - DNA, 201 bp, Homo sapiens
cagtaaagaggctggagaggagctgggtgagtctggggacagggaagggggagggcaagagagatcctgagtgggtgagtggggagaagcatggctgagcrctgagaggagggttggggacgggagacaaggagagagaaagtaggagcatgagagaggcagagaaaatcgaggcaaaagagaaagagaaaatgagacaga

SEQ ID NO: 84120 - DNA, 201 bp, Homo sapiens
cattccagctatcgcaaggctgaggcaggaagatagcttgagctcaggggttgaagacaatcctggacaacatagtgggactctgtctccaaagaaaaaagagagagagagagagagagagagagagggagagagagagagagagagggagagaagtaagaaaggctggaggtgggagcagaactcacagggaaggatctg

SEQ ID NO: 84121 - DNA, 201 bp, Homo sapiens; identical to SEQ ID NO: 64505

SEQ ID NO: 84122 - DNA, 201 bp, Homo sapiens; identical to SEQ ID NO: 64507

SEQ ID NO: 84123 - DNA, 201 bp, Homo sapiens; identical to SEQ ID NO: 64509

SEQ ID NO: 84124 - DNA, 201 bp, Homo sapiens; identical to SEQ ID NO: 64513

SEQ ID NO: 84125 - DNA, 201 bp, Homo sapiens; identical to SEQ ID NO: 64514

SEQ ID NO: 84126 - DNA, 201 bp, Homo sapiens
ttttaccagttcctgaaaaagtggttcgttaagggggctagtcttttgagacatcacacgaaaacggaaggtgagatagactggacatttgagggagaaayattccaaggaaggatcttttttgttgtttattttcaagaaataaaattgaaggtaaaatgaagatgcttaaagagacaaagataggccaggtgcagtggc

SEQ ID NO: 84127 - DNA, 201 bp, Homo sapiens; identical to SEQ ID NO: 64515

SEQ ID NO: 84128 - DNA, 201 bp, Homo sapiens; identical to SEQ ID NO: 64516

SEQ ID NO: 84129 - DNA, 201 bp, Homo sapiens; identical to SEQ ID NO: 64517

SEQ ID NO: 84130 - DNA, 201 bp, Homo sapiens
cacagtagtataatggggagtcaacaaagaatgagtaaaagttgtgtccaagaacactgatgactctctgagattagctggccaggattagttataggcckcttatggtgactcagctgtctactgcagcgcttggcagcctaagacaaagccccaagaatgagaccacttagtttacccaagtcaatttttgagacagag

SEQ ID NO: 84131 - DNA, 201 bp, Homo sapiens; identical to SEQ ID NO: 64521

SEQ ID NO: 84132 - DNA, 201 bp, Homo sapiens
atcaatcagaaacttatctttcaggttttgagcccagttctctacaggagaatcccaggagtggaagtggaaggcagtagaagacagggagggcacgcctytgggaacacgggaacatgggtgggcatgagatccttgaataagacagcctgaagttcggaagagaccaaggcctctgaaggaccaggcagatgttcaggg

SEQ ID NO: 84133 - DNA, 201 bp, Homo sapiens
catgatgaaaccctatctctactaaaaataccaaaattagccaggcacggtggcgcatgcctgtaatcccagctactcggggggccgaggcaagagaatcrcttgaacctgggaggtggaagttgcagtgagccaagatcatgccgtagcactccaacctgggcaacagagcgagacgccatctcaaaaaaaaaaaaaagt

SEQ ID NO: 84134 - DNA, 201 bp, Homo sapiens
gattttgccactgcatttcagcctgagcaatggagggagaccttgtctctaaataaaatacaatttaaattgggaatagtagtaaatggagtttaaaaaawaataattttggctaggtatggtgggtcacacctgtaatcccagtactttgggaagcccaggagggcagatcacttgagttaaagagttggaggccaggcc

SEQ ID NO: 84135 - DNA, 201 bp, Homo sapiens; identical to SEQ ID NO: 64523

SEQ ID NO: 84136 - DNA, 201 bp, Homo sapiens; identical to SEQ ID NO: 64525

SEQ ID NO: 84137 - DNA, 201 bp, Homo sapiens
cgcccaggacacaactgggaacttggcaaaaagaaaggacagggctgcaaggagagtacagacatgtgctggtgagtgcactgtctgcatagttacaccaragcatcttatcaatcagaaacttatctttcaggttttgagcccagttctctacaggagaatcccaggagtggaagtggaaggcagtagaagacagggagg

SEQ ID NO: 84138 - DNA, 201 bp, Homo sapiens; identical to SEQ ID NO: 64526

SEQ ID NO: 84139 - DNA, 201 bp, Homo sapiens; identical to SEQ ID NO: 64529

SEQ ID NO: 84140 - DNA, 201 bp, Homo sapiens
accatgttagccaggatggtcttgatctcctgacctcgtgatccgcccgcctcggactcccaaagtgctgggattacaggcgtgagccaccgcgcctggcygagaatattttaaactaccacacttaccatgcatgtggtaaactatcagtctgtatttatcagtgatggttatttcctaatacccaggaggcatccatgt

SEQ ID NO: 84141 - DNA, 201 bp, Homo sapiens
ttaagtgaaaagtggaatacatagtcaaagaatttgggcactgccttggtggctggaggcaggtcagaaaatgtcagttggcatggtagaacttctaggaygctgaaatagtttgtggagacacaagtaagaattttttttttttttttttgagacggagtcttgctctgtcacctaggctggagtgcagtggcacgatct

SEQ ID NO: 84142 - DNA, 201 bp, Homo sapiens
agcagctctccacaccagccaagggggcccccacactcccgcgctgctctgcggctcagggagcagcccacctgctgggtgtgctgatatcaccctccctwcttccccccagtgcccacacccacccaggcccaggctccttcccctccatcatccccttaccagcacctagaaccatccagggctgaaaagtcccctcca

SEQ ID NO: 84143 - DNA, 201 bp, Homo sapiens
atataaaatataattatatatatattttgtttgtttgttttagtaaagacgggttttcaccatcttggccaggctggtattgaactcctgaccttgtgatycattgtccccccccccagcctcccaaagtgctgggattacaggcgtgagccaccgtgcctggccacatctgatcctctctacagttttgtagccagcttt

SEQ ID NO: 84144 - DNA, 201 bp, Homo sapiens
actattgcccctggctccattactcacatttgccctggtaatagacggtgctgcccacggccacagagagaaagctgacagcatagaatccagcccgaagkaggaggactgtaccagcccctagctgaggatgttctgcatggggcaatggagacgggggttggggaagaagtgcacacaggctcagggagggaaggggcc

SEQ ID NO: 84145 - DNA, 201 bp, Homo sapiens
tgaaagcatgatccgggacgtggagctggccgaggaggcgctccccaagaagacaggggggccccagggctccaggcggtgcttgttcctcagcctcttccccttcctgatcgtggcaggcgccaccacgctcttctgcctgctgcactttggagtgatcggcccccagagggaagaggtgagtgcctggccagccttcat

SEQ ID NO: 84146 - DNA, 201 bp, Homo sapiens
gtgattctcctgactcagcctcccaagtagctgggattacaggcacatgctaccacgcctggctaatttttgtatttttagtagagacagggtttcaccaygttggccaggctggtctcgaactcctgacctcaggtgatccacccgcctcagcctcccaaagtgctgggattacaggccatgagccaccacgcccggcct

SEQ ID NO: 84147 - DNA, 201 bp, Homo sapiens
ttacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcagaggcgcgatctcggctcactgcaacctccgcctcccag

SEQ ID NO: 84148 - DNA, 201 bp, Homo sapiens
gtggtaaactatcagtctgtatttatcagtgatggttatttcctaatacccaggaggcatccatgtgagccacccttccattgctttaagaccaagggagygagtgaccagcaggattcaagatggcagctctgccgaggagtgggagtcccagctaacttctgctccctgctctcccaccaacagcctacaccgatttct

SEQ ID NO: 84149 - DNA, 201 bp, Homo sapiens; identical to SEQ ID NO: 83493

SEQ ID NO: 84150 - DNA, 201 bp, Homo sapiens
gtcagaatggtgaacacagaataactgagaatcatctcttagttctacccacagattttacagttgagggaaattttaccagttcctgaaaaagtggttcrttaagggggctagtcttttgagacatcacacgaaaacggaaggtgagatagactggacatttgagggagaaatattccaaggaaggatcttttttgttgt

SEQ ID NO: 84151 - DNA, 201 bp, Homo sapiens; identical to SEQ ID NO: 83494

SEQ ID NO: 84152 - DNA, 201 bp, Homo sapiens
gttccatggctttaaacaccatcctcatgctgaccatgcccaggtttctttctctagcttggaccttgcccctgaaatccagatgtgtatctgcccagtgrcatctctacttgcatgtctaatagacttagacttaccacacccaaaatagaattttttagtttttccatccatcagaatcctgcttctctcccagtatct

SEQ ID NO: 84153 - DNA, 201 bp, Homo sapiens
tgagggtatatttttctgcctctaaaactgttggagagggaatctgagaaagctgcaaccaaccaggaggctggggtacgctggagaaggaatgggcttcmtaaccttgagccctcttccctgaagatatatgtatctacgggggcctggggctgggcgggctcctgcttctggcagtggtccttctgtccgcctgcctgt

SEQ ID NO: 84154 - DNA, 201 bp, Homo sapiens; identical to SEQ ID NO: 64560

SEQ ID NO: 84155 - DNA, 201 bp, Homo sapiens; identical to SEQ ID NO: 64561

SEQ ID NO: 84156 - DNA, 201 bp, Homo sapiens
tgaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaa

SEQ ID NO: 84157 - DNA, 201 bp, Homo sapiens; identical to SEQ ID NO: 64563

SEQ ID NO: 84158 - DNA, 201 bp, Homo sapiens
gaggtgggagaatcgcttgaactcaggaggcagagggtgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaa

SEQ ID NO: 84159 - DNA, 201 bp, Homo sapiens
taatgccattctctcgcctcagccttccgagtagctggggctacaggcacccaccaccacgcccagctaattttgtttttgtatttttagtagagacgggrtttcaccttgttagccaggatggtctcgatctcctgacctcgtgatccacccgcctcagcctcccaaagtgctgggattacaagtgtgagccactgcgcc

SEQ ID NO: 84160 - DNA, 201 bp, Homo sapiens
gcacccaccaccacgcccagctaattttgtttttgtatttttagtagagacggggtttcaccttgttagccaggatggtctcgatctcctgacctcgtgakccacccgcctcagcctcccaaagtgctgggattacaagtgtgagccactgcgcccagccgatctttgtggcttttaaagtcactaaagatggtggtagga

SEQ ID NO: 84161 - DNA, 201 bp, Homo sapiens
cccccacccccacacgctttcccactgctttcccagaacactgcctggccctggagccactgggaagccaacaggggagtccacgcctgctggtggggggrgcccgggagggcccgggagaagcacaaagggtgggctgtgttgagcttcttcttttcttccagtaaagaggctggagaggagctgggtgagtctggggac

SEQ ID NO: 84162 - DNA, 201 bp, Homo sapiens
aggatgatggtagggataagatgtggagaaagactgagctagttatacaagttgttaagagcataataaatattttgatggataagattgtgctgtgaagrcaggaagagcatggcaaatgcaaaaggcacgtgctttgggagatgaggaggagtttatcagtggtctgggggagagaaaataacgacccctctcttctgc

SEQ ID NO: 84163 - DNA, 201 bp, Homo sapiens
gatggtagggataagatgtggagaaagactgagctagttatacaagttgttaagagcataataaatattttgatggataagattgtgctgtgaagacaggragagcatggcaaatgcaaaaggcacgtgctttgggagatgaggaggagtttatcagtggtctgggggagagaaaataacgacccctctcttctgccttca

SEQ ID NO: 84164 - DNA, 201 bp, Homo sapiens
atataattatatatatattttgtttgtttgttttagtaaagacgggttttcaccatcttggccaggctggtattgaactcctgaccttgtgatccattgtccccccccccagcctcccaaagtgctgggattacaggcgtgagccaccgtgcctggccacatctgatcctctctacagttttgtagccagcttttttcaaa

SEQ ID NO: 84165 - DNA, 201 bp, Homo sapiens
cttctgtgtctcagtcctctcagtccatctcgagcctccgttcaaattgatcatcatcaaaacttatgtggctttttgacctttgaatagggaattttttwaattttttaaaaattaaaataaaaaaaacacatggctcacccttccacccactctggggtcaaatagtaatttattgggtgaatgacagtgttcagggac

SEQ ID NO: 84166 - DNA, 201 bp, Homo sapiens
tttgacctttgaatagggaattttttaaattttttaaaaattaaaataaaaaaaacacatggctcacccttccacccactctggggtcaaatagtaatttrttgggtgaatgacagtgttcagggacccaagctcccctaacagccagaagagggtatgtgtgggcctggcaggaaagggcagttgccaaggaggagtcat

SEQ ID NO: 84167 - DNA, 201 bp, Homo sapiens
cttttttctttttttgagatggggtcttgctctgttgcccaggctggaatgcagtggtgcaatcttggctcactgcaaactccgtcccctgggttcaagcratcctggtgcctcagcctcccaagtagctgggactacaggcacccaccaccacgactggctaatttttgtattttcagtcgagacagggtttcaccatct

SEQ ID NO: 84168 - DNA, 201 bp, Homo sapiens
tctacgaaagatacaaaaattagccaggcgtggtggcacatgcctgtggtcccagctattcactgaggtgggagaatcgcttgaactcaggaggcagaggktgcagtgagccgagatcacaccactgcactccagcctgggtgacagagcgagactcagtctcaaaaaaaaaaaaaaaaaaagcccaggtgcggtggctca

SEQ ID NO: 84169 - DNA, 201 bp, Homo sapiens
taacccaagggtgagtgggcggttgggcgggtgagaccaggatgtgggttcccccaccttccgaggttcaaggagaccagcttttacccagaacaagcctscaggagccctccttggcccagaagctaacctacttaccctccctgctgctcaccagtacccagacccatcccacccattcccttcctggaatctggcctc

SEQ ID NO: 84170 - DNA, 201 bp, Homo sapiens
aagatgtggagaaagactgagctagttatacaagttgttaagagcataataaatattttgatggataagattgtgctgtgaagacaggaagagcatggcaratgcaaaaggcacgtgctttgggagatgaggaggagtttatcagtggtctgggggagagaaaataacgacccctctcttctgccttcattcccctagtga

SEQ ID NO: 84171 - DNA, 201 bp, Homo sapiens
tggagaaagactgagctagttatacaagttgttaagagcataataaatattttgatggataagattgtgctgtgaagacaggaagagcatggcaaatgcaraaggcacgtgctttgggagatgaggaggagtttatcagtggtctgggggagagaaaataacgacccctctcttctgccttcattcccctagtgatggagg

SEQ ID NO: 84172 - DNA, 201 bp, Homo sapiens; identical to SEQ ID NO: 64575

SEQ ID NO: 84173 - DNA, 201 bp, Homo sapiens; identical to SEQ ID NO: 64577

SEQ ID NO: 84174 - DNA, 201 bp, Homo sapiens
gtcacccaggctggagtgcagtggtgtgatctgggctcactgcaagatccgcctcccgggttaatgccattctctcgcctcagccttccgagtagctgggrctacaggcacccaccaccacgcccagctaattttgtttttgtatttttagtagagacggggtttcaccttgttagccaggatggtctcgatctcctgacc

SEQ ID NO: 84175 - DNA, 201 bp, Homo sapiens; identical to SEQ ID NO: 64579

SEQ ID NO: 84176 - DNA, 201 bp, Homo sapiens; identical to SEQ ID NO: 64581

SEQ ID NO: 84177 - DNA, 201 bp, Homo sapiens
cccagtgcccacacccacccaggcccaggctccttcccctccatcatccccttaccagcacctagaaccatccagggctgaaaagtcccctccaaaccacstggtcagcccagggcagaggaaagggctgggctctggagttgggcagagctggccttaaaccccagctccacctttctgggatgggtgacctagtaaagt

SEQ ID NO: 84178 - DNA, 201 bp, Homo sapiens; identical to SEQ ID NO: 64583

SEQ ID NO: 84179 - DNA, 201 bp, Homo sapiens; identical to SEQ ID NO: 64584

SEQ ID NO: 84180 - DNA, 201 bp, Homo sapiens; identical to SEQ ID NO: 64585

SEQ ID NO: 84181 - DNA, 201 bp, Homo sapiens; identical to SEQ ID NO: 64586

SEQ ID NO: 84182 - DNA, 201 bp, Homo sapiens
caggttcaagtgattctcctgactcagcctcccaagtagctgggattacaggcacatgctaccacgcctggctaatttttgtatttttagtagagacaggrtttcaccatgttggccaggctggtctcgaactcctgacctcaggtgatccacccgcctcagcctcccaaagtgctgggattacaggccatgagccaccac

SEQ ID NO: 84183 - DNA, 201 bp, Homo sapiens
caggtggggaacaagcgaatgagagacaggaccaggtactttctgggtgggacaagttgagagggtctgtgacaggtcacagcagcactagggagaagtgccccccccaccaaccctgatgtgatttgggtagggatggtgggccttcgccagccacacctgggccattctgtcttcttgccttcctggccttgccttccc

SEQ ID NO: 84184 - DNA, 201 bp, Homo sapiens
ctctgccgaggagtgggagtcccagctaacttctgctccctgctctcccaccaacagcctacaccgatttcttcctcccgctgctaagccgctgtccctcygccatgggaataaagaataaggatggggagacccctggccaaattttgggctggggacccccctgggattctgctgaagaggaggaagaagatgatgcct

SEQ ID NO: 84185 - DNA, 201 bp, Homo sapiens; identical to SEQ ID NO: 64603

SEQ ID NO: 84186 - DNA, 201 bp, Homo sapiens
tgggaagcccaggagggcagatcacttgagttaaagagttggaggccaggccaggcatggtggctcatgcctgtaatcccagcactttgggaggctgaggygggcggatcacgagttcaggagatcgagaccatcctggctaacacggtgaaaccccatctctactaaaaatacaaaaaattagctgggtgtggtggcatc

SEQ ID NO: 84187 - DNA, 201 bp, Homo sapiens; identical to SEQ ID NO: 64606

SEQ ID NO: 84188 - DNA, 201 bp, Homo sapiens
ctgcacttctgctccccaccccccagaattcctcttaaacccagaagggtcccagtttccagaccctagtcagtatatctggctctggggtgaagagaacrgccccctcttcaccctcaaacaggaaccagtggttggaggggaggaagtgcctgaggggaagttatggggccccagatactcctccatgccccacttcag

SEQ ID NO: 84189 - DNA, 201 bp, Homo sapiens
gcctgggaacgattataacagagggcccctcacttcacagatgaggaacttgaggcaagtcaccagcccctgatcatttcgcctaaaagagcaaggactaragttcctgacctccaggccagtccctgatccctgacctaatgttatcgcggaatgatggtaagtaaagtgtctcttgcatctgcatagagagagtcctgg

SEQ ID NO: 84190 - DNA, 201 bp, Homo sapiens; identical to SEQ ID NO: 64609

SEQ ID NO: 84191 - DNA, 201 bp, Homo sapiens; identical to SEQ ID NO: 64611

SEQ ID NO: 84192 - DNA, 201 bp, Homo sapiens
aattgcttgaacacaggagatggaggttgcagtgagccaagaatgtgccactgcactccagcctgggtgacagagcaagaatgtctcaggaaagaaaaaawaataataaataccaaataaaattaataaaatatcaatccttcctattctagtagttgtggcttaaataaataaataaatatttttaaaaataaaacatag

SEQ ID NO: 84193 - DNA, 201 bp, Homo sapiens
aataaataccaaataaaattaataaaatatcaatccttcctattctagtagttgtggcttaaataaataaataaatatttttaaaaataaaacatagggtygagtgcggtggctcaactctgtaatcccagcactttgggaggccaagacaggtggatcacaaggtcaggagtttgagaccagccaggccaatgtggtgaa

SEQ ID NO: 84194 - DNA, 201 bp, Homo sapiens
tactaaagacaatattgcaaatcattattaagaatacaagaagtacaatgtttcttgtttctttaacacctgtgatacaggtgtttgatatgaattctacrtaatggctgcattgcttcttgccaccacccaaagaaggttgtatagcactcagatgtatactaactgcaaccgtgtatctcttaggaatttctcctttgc

SEQ ID NO: 84195 - DNA, 201 bp, Homo sapiens
tcttaggaatttctcctttgccctcttccctccctatcagcatgtatctagcagcattctgaaaagttaactgcacagtgagcgactgctgggcatcttarggggcattcttttctacctaggtattccccctcctccactcatgtctagcatgcaggacttgggtaatctctggggtttcagattctccagacctccatt

SEQ ID NO: 84196 - DNA, 201 bp, Homo sapiens
aaagtccttggccacagtccacctgctccccacctctgtgactttgtccttcctcaatttaatatgctctatgctggaaaactggattattgaacaggcaytggctgatgcattctgaacctaatccactaaaaagcacttgatagatatatcaaaatatcattgagaaatagatattttaggcccatatccatgtcttca

SEQ ID NO: 84197 - DNA, 201 bp, Homo sapiens
gccaaaaccctgtctctacaaaaaatacaaaaattagctgggtgtggaggcacatgccagtcatcccagctactaagtaggctgaggcactagaattgctygaacacaggagatggaggttgcagtgagccaagaatgtgccactgcactccagcctgggtgacagagcaagaatgtctcaggaaagaaaaaaaaataata

SEQ ID NO: 84198 - DNA, 201 bp, Homo sapiens
ccagcagtgcccagaaagtgtgtcccaatcccaggacgttgttgacttacatgagagtaaacgcacccacaaaccagatagtcaaattaagttaatgattmtctcagagacccatgccactggctcagcagggttcaaacattaccttgaatatagagtcttataaaatatttgagagtgcaatgtcaatagatgctggga

SEQ ID NO: 84199 - DNA, 201 bp, Homo sapiens
agcagtgcccagaaagtgtgtcccaatcccaggacgttgttgacttacatgagagtaaacgcacccacaaaccagatagtcaaattaagttaatgattctytcagagacccatgccactggctcagcagggttcaaacattaccttgaatatagagtcttataaaatatttgagagtgcaatgtcaatagatgctgggaag

SEQ ID NO: 84200 - DNA, 201 bp, Homo sapiens
tagcattttttggtctaatcatattaatcagccaacaccagaagtcccaaaaccaatgaaagaattccatccttaatattctgttcctcaagaaccacttytggtatgaaaatctgtattagtcggggttctctagagggacagaactaatggagattatatatatatatatatgagagagagagagagagagtatatgta

SEQ ID NO: 84201 - DNA, 201 bp, Homo sapiens
tgttgcctcaagcagtgcagggtttacatcctcagacaaaggtggaaaggctaatggcagcacgggtcagggaggggatgttaccactactggggatgggraaactgtttcttctggcaaaaaagtttcatcagagttcacaaactcagtgtcctcagcttcatcagggttctcccacacatccccactccaagttccagg

SEQ ID NO: 84202 - DNA, 201 bp, Homo sapiens
cttcacggggaaattaaacttatttttttaagaatttttcaatcatatacaagattttgaactgggaatttcatgaatcaaaaattaaatgaattgcacawaaagccatggcatatgtatttttactacattgtgggagaaaaaataattcttataatttaaaaaaactatgtcttacctgatttcagaaataaaagaagt

SEQ ID NO: 84203 - DNA, 201 bp, Homo sapiens
gagaatgtgccccccaggtcgattaaaacatatgttaatcctgtggcagagaagtttgttctagcctttgggtgtagcctgctgaataagttcacagtgayctacatcctagtttccatgggctgaaatagaatattcatatcccctgcactccctacacacacagacatagacaccaatttccccaaaaaactctttgct

SEQ ID NO: 84204 - DNA, 201 bp, Homo sapiens
cctggtggataaggtgcccaagctagcatggacccctgaatccttgctcgcctcctctgttgccttttaaaagtgccactttctgctcctaaagtgaagtrgtacggcaggactgctgcatttcttcccctaagctagctttggaagcaaatcactttctttataccagacttctctcttcttaattggattctgcaagtg

SEQ ID NO: 84205 - DNA, 201 bp, Homo sapiens
cacctccagggctcatatggcaatggggatttaatagggtttatttgttggtgaagaaacattaaacaaatcttttaataggaaaaatacttttatattayaggcaaaatgtagatgtatattgctactgaagtaaatgtattttattaatggtgtgagaatttcttcctcactgtggtgtgtgaatgtgtatgcatattt

SEQ ID NO: 84206 - DNA, 201 bp, Homo sapiens
caaaatatcattgagaaatagatattttaggcccatatccatgtcttcaccctgcactgtttctcatttgaactctcttttccaggaagagttgtgcttgrgtaaattctatagctcacagtgtgacttcaaaacacacaataaattaataaggtgcttcctacagtgagttcagttaaacattttgaagagtgtttttga

SEQ ID NO: 84207 - DNA, 201 bp, Homo sapiens
ctgatgcattctgaacctaatccactaaaaagcacttgatagatatatcaaaatatcattgagaaatagatattttaggcccatatccatgtcttcacccygcactgtttctcatttgaactctcttttccaggaagagttgtgcttgagtaaattctatagctcacagtgtgacttcaaaacacacaataaattaataag

SEQ ID NO: 84208 - DNA, 201 bp, Homo sapiens
attcttataatttaaaaaaactatgtcttacctgatttcagaaataaaagaagtagaagaaccacttccttatgttccattttgggactggccagcagtgyccagaaagtgtgtcccaatcccaggacgttgttgacttacatgagagtaaacgcacccacaaaccagatagtcaaattaagttaatgattctctcagaga

SEQ ID NO: 84209 - DNA, 201 bp, Homo sapiens
tcacaatcacacacggtgtgtatgtgtgtatgtatgtataaaaatgtggggacctaacccactcaacaaataccctgagtatttgttgaatcattatatgygtatatcatctggcaaatggatgtgtataatttctccagggataagaagcaaatgtataccgatggaaagccttactcaggccataacaaagagagaaat

SEQ ID NO: 84210 - DNA, 201 bp, Homo sapiens
ttaaaaaaactatgtcttacctgatttcagaaataaaagaagtagaagaaccacttccttatgttccattttgggactggccagcagtgcccagaaagtgkgtcccaatcccaggacgttgttgacttacatgagagtaaacgcacccacaaaccagatagtcaaattaagttaatgattctctcagagacccatgccact

SEQ ID NO: 84211 - DNA, 201 bp, Homo sapiens
ggctagatgggtcagaaagcaaccagttcatgataggcaggttcaggtagcatggtgactttatgacccacagtcaaacgttcagttaccaccaaagcccrataacagaccaatagctgtctctcaaaaggagagtagttatctgcagaagtggcagggccttgctccaaaatcctagaggtctccactgtgattcaccta

SEQ ID NO: 84212 - DNA, 201 bp, Homo sapiens
tgttgggaataaataaaaagtgaactaaattatgttctcatcttgggcaaaaattaagcaaaaaaaaaatggaggatatgaagctcctccacaaagaaggycatttttgtactaggcttactacagtgacacaccactattagttggggagaattcagtttttccaaggtgttgataggcatccagatttcagaggaaatt

SEQ ID NO: 84213 - DNA, 201 bp, Homo sapiens
gcggggtcatgtggcccaaatggcagagcagctttcacagcagcctggacctgtttcagagccttcttttgttctagactgcacttaaatctggcagcctytcaggtcacttgataaatgggccagagtaacacacccaaacgaggaatgtgttgcctccaaaatccaaataggcccaccaggcattgtgcctctttcttg

SEQ ID NO: 84214 - DNA, 201 bp, Homo sapiens
cacaagtccaactccttgtcaacttgaacccatacacacatcctgaaatcatacataatcttcaaataaagacaataataaggtcataattatgcctaatrtaatacaactatcctcatacaaccagaaacgcaccaatccccaaaccaaaagttattacataaggttaacaatatttaaatgctgatatgaacaacactt

SEQ ID NO: 84215 - DNA, 201 bp, Homo sapiens
tggcccaaatggcagagcagctttcacagcagcctggacctgtttcagagccttcttttgttctagactgcacttaaatctggcagcctctcaggtcactygataaatgggccagagtaacacacccaaacgaggaatgtgttgcctccaaaatccaaataggcccaccaggcattgtgcctctttcttggttgtaagagg

SEQ ID NO: 84216 - DNA, 201 bp, Homo sapiens
agtccttgatggtgacactaatcacttcagtccctccagggatgggatattgtttttgatttttttatttttctaggtagagacagctctaatggcttctktttggcctttcccaccataatagccctcatcctaccagtcagggagccaatgtggcatttctgccagctaataagtatgtctatacaaattatgcatttt

SEQ ID NO: 84217 - DNA, 201 bp, Homo sapiens
tacctgatttcagaaataaaagaagtagaagaaccacttccttatgttccattttgggactggccagcagtgcccagaaagtgtgtcccaatcccaggacrttgttgacttacatgagagtaaacgcacccacaaaccagatagtcaaattaagttaatgattctctcagagacccatgccactggctcagcagggttcaa

SEQ ID NO: 84218 - DNA, 201 bp, Homo sapiens
gcatggctgtaaaagaaactttttcctctccccgggcattccagcacacattggaaagataacacgtccacagaaagcctggctttccaaaagagcttatsagagaatgtgccccccaggtcgattaaaacatatgttaatcctgtggcagagaagtttgttctagcctttgggtgtagcctgctgaataagttcacagtg

SEQ ID NO: 84219 - DNA, 201 bp, Homo sapiens
gtaggtttcccatcaatttcacttctaggaacaccatgattaattagccaatgccagagctctacatgagtcagactattctgatggctgctttgcctctkctgtctattatggtagttatgcccaccttgcctttgatggttcagtgccaacacttggcccctgccacctcaggatccaattattcccattgtatttaaa

SEQ ID NO: 84220 - DNA, 201 bp, Homo sapiens
gttaatctccttttgccacaccctcacagacataaccgagattaatactttgcatctttcaatccaatcaagttgacagtattaaccatcacaagtccaastccttgtcaacttgaacccatacacacatcctgaaatcatacataatcttcaaataaagacaataataaggtcataattatgcctaatataatacaacta

SEQ ID NO: 84221 - DNA, 201 bp, Homo sapiens
gtgactgtggttcctactgttagatctgacatacagagaagagcaattacgggctcttcaaaaatacaggtgctgctctcacaaatctatttcacaaagcktcggccaagggtgtatcttctggaccctcccagctgggatgagtaggtctaaagtgactaatccactccaccatcctaatctccctaagcctttggatca

SEQ ID NO: 84222 - DNA, 201 bp, Homo sapiens
aaaagacttagcaatttgtgaatagaagatgtttctccgcttctcactgagcatggctgtaaaagaaactttttcctctccccgggcattccagcacacaytggaaagataacacgtccacagaaagcctggctttccaaaagagcttatcagagaatgtgccccccaggtcgattaaaacatatgttaatcctgtggcag

SEQ ID NO: 84223 - DNA, 201 bp, Homo sapiens
caggagagaagcctggctctgaaagcagcgagacttctagggaatacagggtcaggggaggttctgaaagatgacacactgcagagaacatgtgtttgtaygccgatgacaagtatccagtagaaaggcagatgaacagattctcattctcagaaaggcctgtcctgacctcctgagagtacacagaccatgagggcaggg

SEQ ID NO: 84224 - DNA, 201 bp, Homo sapiens
aatgaattgcacataaagccatggcatatgtatttttactacattgtgggagaaaaaataattcttataatttaaaaaaactatgtcttacctgatttcaraaataaaagaagtagaagaaccacttccttatgttccattttgggactggccagcagtgcccagaaagtgtgtcccaatcccaggacgttgttgacttac

SEQ ID NO: 84225 - DNA, 201 bp, Homo sapiens
atatttgctggtaacttccatgaccagaccctctgccaagtgctgcacatccatagcctccctcaagctttccaacaggcagtgctgtacgaggagggggytgaggccttcccgaggttgtgtcgctacccaggggtgcagctgatagacacaaccctttcaggtcttagtttacgagcaagctaggtataaatgttaaca

SEQ ID NO: 84226 - DNA, 201 bp, Homo sapiens
ccaggaagtgtcacaagtgttgtgaggtgacagtgagggttagctggtccagctcaccttcagcctctggcctcaagtgacacagccgggtgcccttggtrggcagtcagagggtctcccccgggcactgggctctgcccttcctcggccccttcatgccagccccttttggtcagcgggtgcggcagacctcctccaaat

SEQ ID NO: 84227 - DNA, 201 bp, Homo sapiens
tgaagatgggcaccatggctttggagtttgagaccagcctggccgacagggtgaaaccccgtctctactaaaaatacaaaaaattagccgggcgtagtggygggcgcctgtagtcccagctacttgggaggctgaggcaggagaatggcgtgaacccaggaggcggagcttgcagtgagccgagatcccgccactgcactc

SEQ ID NO: 84228 - DNA, 201 bp, Homo sapiens
agccgagatcccgccactgcactccagcctgggcgacagagcgagactccgtctcaaaaaaaaaaaaaaaaaaaaatacaaaaattagctgggcatggcascacacacctgtaatcccagctactcgggaggctgaggcaggagaattgcttgaacccgggaggcggaggttgcagtgagccaagatcgcaccactgcatt

SEQ ID NO: 84229 - DNA, 201 bp, Homo sapiens
caccagaagggccaacgtgactgtcccctgagtgaacagaaacgcctctaacatgcgagcgaatggtgcagcccagccggcccgacctcacctggccatgstaggaggcagtgggcaagcggcaacgctgtggtgcccaggacgccggcaggcacagcgccacgtccacgggcaccgcccgttcccaccctgcaggacgcc

SEQ ID NO: 84230 - DNA, 201 bp, Homo sapiens
caccagaagggccaacgtgactgtcccctgagtgaacagaaacgcctctaacatgcgagcgaatggtgcagcccagccggcccgacctcacctggccatgytaggaggcagtgggcaagcggcaacgctgtggtgcccaggacgccggcaggcacagcgccacgtccacgggcaccgcccgttcccaccctgcaggacgcc

SEQ ID NO: 84231 - DNA, 201 bp, Homo sapiens
gcccgacctcacctggccatgctaggaggcagtgggcaagcggcaacgctgtggtgcccaggacgccggcaggcacagcgccacgtccacgggcaccgccygttcccaccctgcaggacgccacagcatcagacgagacggcccgtgtgaagcgccgagaacagagtctggcttccgggagggctcaggaaatgccgagag

SEQ ID NO: 84232 - DNA, 201 bp, Homo sapiens
gttcagacccacgggcaacaaaaacaaaaccttggccaagcactcacaatatcagatattcattaaaaaagtatatataggccgggcaccgtggctcacayctgtaatcccagcactttgggaggccaaggtgggcagatcacttgagctcaggagttcgagaccagcctgggcaacatggcgaaaccccatctctacaaa

SEQ ID NO: 84233 - DNA, 201 bp, Homo sapiens
ttttataaagttcaaaaccaagtaaaactaaacactatgtttagcatacatatatggataaagatagggagggctaaaccccaagttcagcaggtatatawctttttgtttctttttttttttttttccttttttgagatggagtctcgctctgacacccaggctggagtgcagtggcgcaatcttggctcactgcaacct

SEQ ID NO: 84234 - DNA, 201 bp, Homo sapiens
acaaaaacttagctgggcatagtggtgtgtgtctgtggtcccagctacttgggaggctgaggtgggaggattgcttcagcccagggagcagaggttgcagygagtggagatcgcaccactgcactccagcctgggtgacaaagcgagacactgtctcaaaaacaaaaaagaaaagaaaaagctataccatgtgatgtctgc

SEQ ID NO: 84235 - DNA, 201 bp, Homo sapiens
agagtgaggcgcgaacacggaatctgtcccccaagggtgggggcagaagcaccaaaccagagcagagctctagaaggtgcaaagtgttcggagcaggagarccgtgcggggtacctggaagtgccttaggatgaaggtgaacacggccaccacatctgggatcctcaccgctgctggcatggcagtgctctctggaaacct

SEQ ID NO: 84236 - DNA, 201 bp, Homo sapiens
cttctttttttttccccctaagacagggtctctgtcactgaagctggagtgcagcggcgcaatcacagctcactgcagcctcgacctcccaggttcaagasatcatcccacctcagcctccctagtagctggaactataggtgcacgccagtatgcctggctactttttgtttttatagagacacaatctcactatgttgc

SEQ ID NO: 84237 - DNA, 201 bp, Homo sapiens
agaattcatccgacccgtggcttttgtagtctgtggtttctctggactcgctgctgtcttccggggcctggagtgcctggggtgttgctggcccaactctyccctgcaactcctctcttcactaagggctgctctatgcttctccttggccctcgggggcctggctgatcttcgctggatgggcccctgcgagtcaggctc

SEQ ID NO: 84238 - DNA, 201 bp, Homo sapiens
gcggatcacgaggtcaggagctcgagaccatcccggctaacacggtgaaaccccgtctctaataaaaattcaaaaaaattagccgggcatggtggcgggcrcctgtagtcccagctactcgggaggctgaggcaggagaatggcgtgaacccgggaggcggagcttgcagtgagccaagatagcgccactgcactccagcc

SEQ ID NO: 84239 - DNA, 201 bp, Homo sapiens
caggtgcagtggctcatgcctgaaatcttagcactttgggaggctgagatgagaggatcacttgaacccaggagttcgagaccagactgggcaacatagcragatctggtttctaaacacaaaagtaattttaaaaattagccaagcgtggtggcacacacctgcaatcccagctactcgggaggctgaagtgggaggact

SEQ ID NO: 84240 - DNA, 201 bp, Homo sapiens
agctacagtgagctaggatcacgccactgcactccagcctgggcgacagagcaagaccctcatctctttaaaaaaaaaaaagataaatcaaggagcccacstgtccccagagctctcctgccacagtgtcagcacatgccttctgagcataataatccccccggacctgaagcccacgaatgacccccccacccagtcctt

SEQ ID NO: 84241 - DNA, 201 bp, Homo sapiens
tctaaacacaaaagtaattttaaaaattagccaagcgtggtggcacacacctgcaatcccagctactcgggaggctgaagtgggaggactgcttgagcccmggtggttaaagctacagtgagctaggatcacgccactgcactccagcctgggcgacagagcaagaccctcatctctttaaaaaaaaaaaagataaatcaa

SEQ ID NO: 84242 - DNA, 201 bp, Homo sapiens
ctaccaaggacgtcttccccatggaagacaaccacagaacctcccaggtctttggagccatccctgagaccagctaggaggccaaaggacactgatggcaycctttccccagagctggttacaggtctgcctcggactcccctcgtggtggtagtgtctgagcggatcctggctgcccagggcggccgagtgcagaatgag

SEQ ID NO: 84243 - DNA, 201 bp, Homo sapiens
ctcgctctgtctgtcaagcttgaatgcaatggtgtgatctcggctcactgcagcctagaactctcaggctcaagtgatcctcccgcctcagcctcctgagyagctaggactacaggcatgtgccaccacacccagctaagttctttaattttttgtggagatggggtcttgtcgtgttgcccaggctggtctcgaactcct

SEQ ID NO: 84244 - DNA, 201 bp, Homo sapiens
gaagaccaccacagactgttcctttattccctgccctggggccaactgggccaagtggacaagacctcacaagggagagtcaggccagcaatgctcatccmagctccaccctgaccccattcctcttggcatactcagtttctgcctgggctgggcaggctggtccttggcttctggggtcagctcaggattgaggatgaa

SEQ ID NO: 84245 - DNA, 201 bp, Homo sapiens
cctctggcctacagcttgagaatgacgtccaagcagctcgcctttccctgggcggccgctcagacagcttttcagccaaggcagacctcacccagggaccytccacccaggcagcgtggaagtgccagggcccacagacagcacccccccgccccccgccggcctcctcaccccctccgaaggagactccaggcctgctgt

SEQ ID NO: 84246 - DNA, 201 bp, Homo sapiens
ccagaggcacctgccctctctggttgcttagaatattctagaaggggcaggggtcctggcgctcctctgtcctccacatcctctgagtgttctgagcatcytgggctgctttggtgttttctactcccctgctgccctctggtcctgccaccccgagctgacaagcctgccttctgctggctgccttcaaccactcagaga

SEQ ID NO: 84247 - DNA, 201 bp, Homo sapiens
gacaaaagacgctgggccaccagaagggccaacgtgactgtcccctgagtgaacagaaacgcctctaacatgcgagcgaatggtgcagcccagccggcccracctcacctggccatgctaggaggcagtgggcaagcggcaacgctgtggtgcccaggacgccggcaggcacagcgccacgtccacgggcaccgcccgttc

SEQ ID NO: 84248 - DNA, 201 bp, Homo sapiens
tacagatgccaccaccacgcccggctaattttttgtatttttagtagagacagcgtttcacagtgttgaccaggctgttctcaaactcctgacctcaagcratccgcccgccttggcctcccaacgtgctgggattacaggtgtgagccaccgcgtccagtatctttttgtttctgagacagggtctcgctctgtcaccca

SEQ ID NO: 84249 - DNA, 201 bp, Homo sapiens
gtcacacaaccggaggcggagtgtccgtctagtactgggacccggtgtgatgctttaaggaacacacctgccgtccttatgtgagctgggctgggcctttmtttttaatggacacataattgtaatatttatggcatatatagtgatgtttagatacatacaatgtatagtgatcagatcagggtaattagcacagccatc

SEQ ID NO: 84250 - DNA, 201 bp, Homo sapiens
acgtgcccatctagagccttggggtgggcctgtgagagagtggccgcccaccccagtccccaccaggtgcatagtcctgcggctaagtcagggcggttgtracaaaggctcagaccctccaactaccaggctgtgttgtgacgaggctgctggagccccaggcaccatgacgggaatgggtgaatccacccacagtgggtg

SEQ ID NO: 84251 - DNA, 201 bp, Homo sapiens
tacaactataaacgcttagaagaaaacgtaggtgtatattcatgaccttgagtcaggcaaagatttcttagatacaacaccaaaagcacaaccaataaacraagaaacggataagctgaacatcatcaaaattaaaagaaaaaaaaaacctttgtgcttcaaaaggtaccataagtaaagtgaaaatacaaggtacggact

SEQ ID NO: 84252 - DNA, 201 bp, Homo sapiens
aggccagcctcaggagctcctctccctcctcagtggctccatccgtcacctgtagagcttcagcccagctccacagcctagaccattcatccccaagccartatcagtctgaatcagcaccattctgttgatgtacctccttttaaaagccgtctctctctctttttttcttcttttttttttgagacagagtctcactct

SEQ ID NO: 84253 - DNA, 201 bp, Homo sapiens
caagtcatcggctgctccccatccaaacacctgcctcacctcccccgcagagcctttgtaaataaggaagatgtgaagtcctttgtgctgaaaagccctcracagtatttttatgcatttgcctggttgttttatccctgctttccagaactagtgcacagaagggaagaccaccacagactgttcctttattccctgccc

SEQ ID NO: 84254 - DNA, 201 bp, Homo sapiens
tttctttttcttttttttttttttgagacacggagtctcgctctgtagcccaggctagagtgtggtggcgtgatctcggctcgctgcaacctccacctccygggttcaagcgattctcctgcctcagcctcctgagtaactgggatcacaggtacacaccaccaggcctggctaatttttatatttttagtagagacaagg

SEQ ID NO: 84255 - DNA, 201 bp, Homo sapiens
tgagaggagcacccccagaagagaaagtgctgaaccagaagcccaggagagtcatgtgtgtgcgtgtccatctaagcctttgccccaaaacagtaggtagrtcaggtgcagtggctcatgcctgaaatcttagcactttgggaggctgagatgagaggatcacttgaacccaggagttcgagaccagactgggcaacatag

SEQ ID NO: 84256 - DNA, 201 bp, Homo sapiens
ctctgctggactcaatctggggccagcatttgacccccgctcaccctgtttgctatgaatgtcagttcccctcgctactgctggctcccttccccctcaaygctccgtttcctgttccctccaaggccccgttacacaatttccactgtctgctgaagttctagctcaaatccctctcgccgagactttctggtcaccaga

SEQ ID NO: 84257 - DNA, 201 bp, Homo sapiens
gggggctgaggtccccactcccctttcccttcctcctcagcacagcttcccaaacaagccccatgctgagcggcgcccccagactccctaagcttgtcctrgggggtgtgcatctgtgtagccccgtctccagctggaggacttggcctgggctgtcacagcagctgcaagtgcaggctgcaccccagccctccgccccgt

SEQ ID NO: 84258 - DNA, 201 bp, Homo sapiens
agaatggtggcagaggcgagctggggagcagggaggaaccaggctgtcgcaggagaaacagaatattgcgagccagccgtgtggaatggaaaggggaagcyggtcttcctgccccacactcctgcctttcttccttaagggctccttggacagagactgcaggtttctcagaagcactgtccaggatctcaacattctaga

SEQ ID NO: 84259 - DNA, 201 bp, Homo sapiens
ttcctcccctgccagcagctcagccctgatcatctctcacctgaggcccttaaaagcctcccaatcagcctctctgcccccgacccccaggcctgcacccsgtcctctcccgcactgcagcccagcgctgtctaactgagagacctgggttacatttcagcatcccccatgtgattccctgctgtccacaccagcaagtct

SEQ ID NO: 84260 - DNA, 201 bp, Homo sapiens
ctgaggcccttaaaagcctcccaatcagcctctctgcccccgacccccaggcctgcaccccgtcctctcccgcactgcagcccagcgctgtctaactgagmgacctgggttacatttcagcatcccccatgtgattccctgctgtccacaccagcaagtctctgagtgcaacccgcagccacgtgcatcataatcagctga

SEQ ID NO: 84261 - DNA, 201 bp, Homo sapiens
tttcatcttagtctatgtggaaccaggctaagcctttggagtcaaacgtagttgcagctgaagtcacatgtagttgcaggagtcagaaaatactgcatctrcattacagctaacattaaccgtgcaggctcccctctgagcactgggcatgtatccgttcatcttttttacagtaatcctttgagatacgaagctcctacc

SEQ ID NO: 84262 - DNA, 201 bp, Homo sapiens
gagcccaggcgttcaagaccagactgggcaacgtggcaaaacctcgtctcgacaaaaaatgtaaaaattagctgggtgtgctggtatggtcccatagttcmagctacttgagaagctgaggtaggaggactgcttaagcccaggaggctgaggctgcagtgagccatgatcatgccactttactccagcctgggtgacaga

SEQ ID NO: 84263 - DNA, 201 bp, Homo sapiens
gtggttaaagctacagtgagctaggatcacgccactgcactccagcctgggcgacagagcaagaccctcatctctttaaaaaaaaaaaagataaatcaagragcccacgtgtccccagagctctcctgccacagtgtcagcacatgccttctgagcataataatccccccggacctgaagcccacgaatgacccccccacc

SEQ ID NO: 84264 - DNA, 201 bp, Homo sapiens
cagctaacattaaccgtgcaggctcccctctgagcactgggcatgtatccgttcatcttttttacagtaatcctttgagatacgaagctcctacccccccyggttcacagacagggaaactgaggcaggcagagatgaagatgcttaacccagatcacacagctggtaagtggcagagacaggccctctgctgcttggacg

SEQ ID NO: 84265 - DNA, 201 bp, Homo sapiens
tgagcataataatccccccggacctgaagcccacgaatgacccccccacccagtcctttctccctcatgtcacgtcaagtgctgtgtcactgaagcacccygtaccccatcacctggtgccagaggcctggccatggtgcagctggacccccagctgccgtgtgaccgtgggcaaacggattatgtcaccttcccagtgtt

SEQ ID NO: 84266 - DNA, 201 bp, Homo sapiens
agctgaggtaggaggactgcttaagcccaggaggctgaggctgcagtgagccatgatcatgccactttactccagcctgggtgacagagcaagaacctgtytcagaaaaacaacaacaaaaaaaaacaaaaaacataggccgggcacagtggctcacacctgtaatcccagctactctggaggctgaggcaggagaattgc

SEQ ID NO: 84267 - DNA, 201 bp, Homo sapiens
agccctgccagacaggacgtcgggtgcccttggcaggacacttgccaatgaagacagccatggttccaatcagggccctcgctacagctcccctcccagargcacctgccctctctggttgcttagaatattctagaaggggcaggggtcctggcgctcctctgtcctccacatcctctgagtgttctgagcatcctgggc

SEQ ID NO: 84268 - DNA, 201 bp, Homo sapiens
ctgggtgacagagcaagaacctgtttcagaaaaacaacaacaaaaaaaaacaaaaaacataggccgggcacagtggctcacacctgtaatcccagctactytggaggctgaggcaggagaattgcttaaacccaggaggcggaggttgcagcgaaccaagattgcaccactgcactccagcctgggccacggagcgaaact

SEQ ID NO: 84269 - DNA, 201 bp, Homo sapiens
agctcctggccattcccaaatgccccacacccagcagcgcctggaatgtgctcatgcaggttcctcgtgacatggacacacccccttccccatcctacccrcatgtccccagcccaggcctcgttcccactcccccaggatgccccaaccctccaagggaacaaagagaatgctcttccctttctccagaagcccagcacc

SEQ ID NO: 84270 - DNA, 201 bp, Homo sapiens
aataactttcccagcttacacggaggagctgggtttgaatccagacatcacactgatcagcacgcagacccgcagggtttcatactcttccggcatttcasgtacacctctctccatctcaccgcctcaccataggaggtgaggcctattcctatccgcacaatctgacagggaaattgagactcagagaggttaagtaac

SEQ ID NO: 84271 - DNA, 201 bp, Homo sapiens
caggagaattgcttaaacccaggaggcggaggttgcagcgaaccaagattgcaccactgcactccagcctgggccacggagcgaaactctgtctcgggggraaaaaaaaaaaaaaaaaaaaattctaggcaatggatacaatcaggatgatttttcttgctttttgcttaagtgtcttttccatgattaacacatatagtt

SEQ ID NO: 84272 - DNA, 201 bp, Homo sapiens
caggggacaaaagacgctgggccaccagaagggccaacgtgactgtcccctgagtgaacagaaacgcctctaacatgcgagcgaatggtgcagcccagccrgcccgacctcacctggccatgctaggaggcagtgggcaagcggcaacgctgtggtgcccaggacgccggcaggcacagcgccacgtccacgggcaccgcc

SEQ ID NO: 84273 - DNA, 201 bp, Homo sapiens
ggggtcctggcgctcctctgtcctccacatcctctgagtgttctgagcatcctgggctgctttggtgttttctactcccctgctgccctctggtcctgccmccccgagctgacaagcctgccttctgctggctgccttcaaccactcagagaaaccacagctcccccctccgcagaagccgcgctcggagcagcagaagga

SEQ ID NO: 84274 - DNA, 201 bp, Homo sapiens
ctattcctatccgcacaatctgacagggaaattgagactcagagaggttaagtaacttgcctaaggccacatagctcgtaatcagggcagcagggattccrggccgagcaggcaggcccctgatccaggctcctagcctgctgcccagggaggtcagagctggaaaccacttccacagcacaaggagactctgcttggact

SEQ ID NO: 84275 - DNA, 201 bp, Homo sapiens
aagggacggcttcctctgcgagggtgcaagggctgacctgggagagcaggcagctgcgactaacgctggctggggcctgcctgacttccccttgagtcctyagaggcacaggttataacccaatgttttattgcttcttgagaacattattggcattcatctgccttcgaaattttggctattcatttatttatttattta

SEQ ID NO: 84276 - DNA, 201 bp, Homo sapiens
gtccccagctggctgcatggagacctcccagggtgtcattctctctgagctgtcaggccattaaggaggtacacttcaaggtcagggttcctgacaacgcytgccatcccttctcctgtagggacagcatctgttcacgcttctaaacagctccagaaagccatcgttaaactgaaacccactggaggcgggggaagaaag

SEQ ID NO: 84277 - DNA, 201 bp, Homo sapiens
ctggcgctcctctgtcctccacatcctctgagtgttctgagcatcctgggctgctttggtgttttctactcccctgctgccctctggtcctgccaccccgmgctgacaagcctgccttctgctggctgccttcaaccactcagagaaaccacagctcccccctccgcagaagccgcgctcggagcagcagaaggaaggcga

SEQ ID NO: 84278 - DNA, 201 bp, Homo sapiens
cctatccgcacaatctgacagggaaattgagactcagagaggttaagtaacttgcctaaggccacatagctcgtaatcagggcagcagggattccaggccragcaggcaggcccctgatccaggctcctagcctgctgcccagggaggtcagagctggaaaccacttccacagcacaaggagactctgcttggactgtgct

SEQ ID NO: 84279 - DNA, 201 bp, Homo sapiens
gcacaggttataacccaatgttttattgcttcttgagaacattattggcattcatctgccttcgaaattttggctattcatttatttatttatttatttayttatttatttatttgagatggagtctcgctctgtctcccaggctggatggagtacggtggcccgatctcggctcactgcaacctccacctcctgggttca

SEQ ID NO: 84280 - DNA, 201 bp, Homo sapiens
atagctcgtaatcagggcagcagggattccaggccgagcaggcaggcccctgatccaggctcctagcctgctgcccagggaggtcagagctggaaaccacytccacagcacaaggagactctgcttggactgtgcttggcctcacgtgacctctgacctccctggccctcctgtgaccctgacaggtgtgctgagcttctg

SEQ ID NO: 84281 - DNA, 201 bp, Homo sapiens
tggtacactctctaccacagccaccctgggctccccatacccaccccaggacctttcctcggggcttatcttagctctgataagatccacccctcagggcycacaatctcaacagtgtcctaacctcggtaagagtctctagcaagaggtgcagcctgcaagatgatcttcgcattcctgcgctcacttccttgaagatgg

SEQ ID NO: 84282 - DNA, 201 bp, Homo sapiens
ccctcccctcttgaaaaagaccatctgctgggtgcggtggctcaagcctgtaatctcaacactttgggaggccgaggtgggcggatcacgaggtcaggagmtcgagaccatcccggctaacacggtgaaaccccgtctctaataaaaattcaaaaaaattagccgggcatggtggcgggcgcctgtagtcccagctactcg

SEQ ID NO: 84283 - DNA, 201 bp, Homo sapiens
gatgtcacatgacaagccagagccgtgacatttggccccaatctccttgtgggtccccctgaatccccaggctcctctttggcctactctgtacccagaamtctcacctttcctggggcagttggtcccttggcttagaacacctgtgcacaccccaccctgctgccgctaaatgaccaggggttacggtccccagtgccg

SEQ ID NO: 84284 - DNA, 201 bp, Homo sapiens
gcacgccaccacacccagctaatttttgtatttttagtagagacggggattcaccatattggtcagactggttacaaactcctgacctcaggtgatccacycgcctcggcctcccaaagtgctgggattccaggcatgagccaccatgcccagcctgcactgggttttggactggctgtgttagcatcacctggggcaggg

SEQ ID NO: 84285 - DNA, 201 bp, Homo sapiens
gagggctgcccaagacagtgaataacctggccagagatgtcagtagtgccgagactgacaatcccacccaaagggcaagggttaggattcaggtagggatkgaggggcacaaagggcagcccttggaaacaaatattgagaagagcaggtggaagtaaaagaggaagtctgggcctctggagggagaattgatcgtaaagg

SEQ ID NO: 84286 - DNA, 201 bp, Homo sapiens
gcctcaggtgatccgcccaccttggcctcccaaagtgttgggattaaaggtgtgggccaccgcctggcctattgttaattacattaatccaacagtgacayggaacattataactcattcctcctatctagctgtaattttgtatcctttaacaaatctctccctctctcctcccccaacccttcccagactctagtattc

SEQ ID NO: 84287 - DNA, 201 bp, Homo sapiens
ctgaggtgggagaatcgcttgggccaggaaattgaagctgcagtgatctgtgattgcaccactgcactccagcctgggtgacacagcaagactccgtctcaaaacaaaaaaaaaattatatttggagtacaactctgaatccatatgctaactattcataacattcttagcaccgaggctgtactgggcacccctccggag

SEQ ID NO: 84288 - DNA, 201 bp, Homo sapiens
taaacagcaggaattcggctgaggtgtccaaatctcggggaggatgaattctcaggagagctgaacctgagacaaagccctttgtcctgggctggaaggaycctggaaaggttatctggtccctgactcagggaagggaggcattctccctgcaggaatgttctcgatcacagtccaccaccacccccctacccccgccca

SEQ ID NO: 84289 - DNA, 201 bp, Homo sapiens
ccatgggggtgcaggtgtctctctgatgcactgattccctttcctttggataaatgcccagtcgtgggactgctggatcatatggccgttctatttgtagytttttgaggaacctccaccatagtgactgtactactttccattcccacccaccgcatatacgagttcccttttctccccttccttgcctgagctgggcct

SEQ ID NO: 84290 - DNA, 201 bp, Homo sapiens
agtacccaagcccacctgcagctcacaaacgacaggccaggactgcgtacgtggctctgcacccccagaagggtgcaaataggggaggcccgagaggctcygaggctggcactgtcctcagatcccagatagggagaaacgtgtgttgtccagagagctccttccagcacctgccatacctccaggctgtgcacagctctc

SEQ ID NO: 84291 - DNA, 201 bp, Homo sapiens
caacggaactgcccaggggcacggggcaaggctgagcagccaggaagtgtcacaagtgttgtgaggtgacagtgagggttagctggtccagctcaccttcrgcctctggcctcaagtgacacagccgggtgcccttggtgggcagtcagagggtctcccccgggcactgggctctgcccttcctcggccccttcatgccag

SEQ ID NO: 84292 - DNA, 201 bp, Homo sapiens
cctgctctagtcctctaggtttggaggccacgcctctcccaacggaactgcccaggggcacggggcaaggctgagcagccaggaagtgtcacaagtgttgygaggtgacagtgagggttagctggtccagctcaccttcagcctctggcctcaagtgacacagccgggtgcccttggtgggcagtcagagggtctcccccg

SEQ ID NO: 84293 - DNA, 201 bp, Homo sapiens
gaagggtgggaaggcctgcaaggggcctgcgtgcattctgtgtgcatcgacccaggacaccacggttggtgcctctgagttcatcacgtcgatcatccccrtcttctttctgctcaagtacttgatttgtcaacatgcacagaagggtgagacctggccatggtgctgcttgaatcttgttaacagttaggctctgattca

SEQ ID NO: 84294 - DNA, 201 bp, Homo sapiens
ggggtgggtcacgttagaatgagtcctggctaggcccacagcaggcttttccacccgaatactggggccacagctcatgaatctgtgtgtatccatatccygggctgggtcagctctccagggtggagatggttgggcaggcagcctctgggggcaagctcgggctcaggcctccccttgaccagcttcacagagacagac

SEQ ID NO: 84295 - DNA, 201 bp, Homo sapiens
gtttggagggccacaggcacctttgagaagttggcggctgccactgtccacaaaaaaaacacgtacgcgtgcacacacacacacacacgcgcacacacacwctcacacacacacacacacacacacaacttcacttacagtttccgggcttgtgaccacccccaaacccgccaggcctatctctggctgggtgttcacaca

SEQ ID NO: 84296 - DNA, 201 bp, Homo sapiens
gtgatccgcccaccttggcctcccaaagtgttgggattaaaggtgtgggccaccgcctggcctattgttaattacattaatccaacagtgacacggaacaytataactcattcctcctatctagctgtaattttgtatcctttaacaaatctctccctctctcctcccccaacccttcccagactctagtattctctgttc

SEQ ID NO: 84297 - DNA, 201 bp, Homo sapiens
cctgcaactgctgtaataaatgactatttttcatggccctgctctcagatcgctgtgggatccctaaatgtttgtgtgtaactaatctcgttgggcttcargatcacagtaaagacagcttagaaacatggaagctctccattcgggcagcacctccttcttttagcaggatggggccgacctcgccagctggagcagcag

SEQ ID NO: 84298 - DNA, 201 bp, Homo sapiens
gatctcagctcactgcaacctccgcctcctgggttcaagcgattctcctgcctcagcctcccgaatagctgggactacaagtgcgcgccgccacgcccggstaatttccgtatttttagtagagacggggtttcaccctgttggccaggctggcctcgaactcatgacctcaagtgatccacctgcctcggcctctcacag

SEQ ID NO: 84299 - DNA, 201 bp, Homo sapiens
tcaatgtatctgaggttgttggaagggagggagagagacagactctgaaaccatcctagtacagggatcagcaaactatggcacaaagggcagatgccgcycaccacctatttttgtagagtctcattggaacctggccacgccctttcatttacatctcatctgtggctgcttctgagcagctgcagtagagctgggtaa

SEQ ID NO: 84300 - DNA, 201 bp, Homo sapiens
gtgccagggcccacagacagcacccccccgccccccgccggcctcctcaccccctccgaaggagactccaggcctgctgtgcactcctgtggcatcggggrgcggggggcaagcatcacagtcatagggagtgtgaggcgcccagaatgggggctccacagtcaggcctgcaccccggctgcaggataccagatcctgtgg

SEQ ID NO: 84301 - DNA, 201 bp, Homo sapiens
tgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgc

SEQ ID NO: 84302 - DNA, 201 bp, Homo sapiens
ggaggctgaggcaggagaatggcgtgaacccgggaggcggagcttgcagtgagccaagatagcgccactgcactccagcctggagacagagtgagactccrtctcgaaaaaaaagaaaaagaaaagaagaccatcctagccatgcagccacttgccctccgtccctggtttgtgagcctgtgcgtgcaccgggggacagag

SEQ ID NO: 84303 - DNA, 201 bp, Homo sapiens
gaaccccaccctcaccacagatgggaacagacacagagagcctcagccccgcagtggtctcaggggcccactgaccaaaggtggccggaatcgcttccccrcctccacctgcagcccggcctctgccctggctggctactcatagcaggctgttgccatgggaacagcagagctgttgagctgtgacatcatggcaggggt

SEQ ID NO: 84304 - DNA, 201 bp, Homo sapiens
gtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgca

SEQ ID NO: 84305 - DNA, 201 bp, Homo sapiens
ctcctgcccctgccactgccacgtctgcctgtctttgcttccttcttatctcctcctccctgctgttgcatccctcctcgcagctgcctgggaagcctcgrgcagacctctttgttgtttccgaacccaagacgttcacccctacacacgacccccactgcatcgagtcagtggttctgcatcaggactggagacggctgc

SEQ ID NO: 84306 - DNA, 201 bp, Homo sapiens
atctccaacccagtcccaccagcttccctcactctccttcccatcacactgcctgtggggagccccgtggtgcagggactttgccgctggccttgcgaacmcacggcttggagcccctccttggcccactctccggggccctcttgggagcctcgctaaacagctgggcatggaaagaaccccaccctcaccacagatggg

SEQ ID NO: 84307 - DNA, 201 bp, Homo sapiens
tgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcat

SEQ ID NO: 84308 - DNA, 201 bp, Homo sapiens
cactccataattgcttgttgaaacacagacaagcccaatatgaaaatcaagatgaacaaaactgacaatacagatcgatcacatacttcgcacaacgagtygccaacagtttctttaaaaagcgccacgccgccccctcgcatggaaggcctgacccagctcacatgaatctgatgctgtgttgcttttcctgagcacgtg

SEQ ID NO: 84309 - DNA, 201 bp, Homo sapiens
ctgcaaacctcaagatcctaagcacccagcctaggtcaggggtccccaatcccagcaggtgttcctgcttcctgaagaccccccagcccaactcctccaayaaccatattcatctccaacccagtcccaccagcttccctcactctccttcccatcacactgcctgtggggagccccgtggtgcagggactttgccgctgg

SEQ ID NO: 84310 - DNA, 201 bp, Homo sapiens
ccacgtccacgggcaccgcccgttcccaccctgcaggacgccacagcatcagacgagacggcccgtgtgaagcgccgagaacagagtctggcttccgggarggctcaggaaatgccgagagctcggcagagacacccacgtggtgctggattccacgcacgaggaaccgacgggcagacgtggagctaaatgatggtcaac

SEQ ID NO: 84311 - DNA, 201 bp, Homo sapiens
agtttcaaaatcaataaaaccgtgatgaaatgatcaggaataaacctgtccagaactgttcaagacctaaaggagatgcacgggctgaagaacaaggagcraatctgaacgagggagaggtgtgtcttcctggacagttctcgggagaggaggagggcggtaaggacggggagaagaggccgcaggcttggagtccaggag

SEQ ID NO: 84312 - DNA, 201 bp, Homo sapiens
gccaaaggaggtgaggtggggcaagggtgtttgcaaaggatagaaaagtctagaatggcagagtatggtgcttaagagtactatgtgacctaggccaagcracttcactctgggtgcctcagtttgctctttaggatggggatgataacaacagcagcacccatctacagagatgccagtgcttgtcaccacgagaagcac

SEQ ID NO: 84313 - DNA, 201 bp, Homo sapiens
ccaggaagtgtcacaagtgttgtgaggtgacagtgagggttagctggtccagctcaccttcagcctctggcctcaagtgacacagccgggtgcccttggtyggcagtcagagggtctcccccgggcactgggctctgcccttcctcggccccttcatgccagccccttttggtcagcgggtgcggcagacctcctccaaat

SEQ ID NO: 84314 - DNA, 201 bp, Homo sapiens
gccaaaggaggtgaggtggggcaagggtgtttgcaaaggatagaaaagtctagaatggcagagtatggtgcttaagagtactatgtgacctaggccaagcyacttcactctgggtgcctcagtttgctctttaggatggggatgataacaacagcagcacccatctacagagatgccagtgcttgtcaccacgagaagcac

SEQ ID NO: 84315 - DNA, 201 bp, Homo sapiens
tgtgagtccagggggcacccctgagcccgccaacatagccctatgaggtgcctggcacttcggggaggatttaggctcgcaaggcagggggcaggccctgygcacttgtgtccggaagagaggtggtgggaagagagatgctggaagctgggtgtgaggggtgtgaggggtgtgaggggcaggaggtggagggccaggcct

SEQ ID NO: 84316 - DNA, 201 bp, Homo sapiens
ggcactggcccctcccagccgtccaccctcttctgcaggctccagctttcacctggggaggggcgcccataggaccagcactggcagggaaagcgcctccytcccctctgtcctgtcctgcttatggcccagcggagaacgccaaggggtccccatgttctcaacatgggtcattcctgggagtcgggtgggggcttcaca

SEQ ID NO: 84317 - DNA, 201 bp, Homo sapiens
gagacacccacgtggtgctggattccacgcacgaggaaccgacgggcagacgtggagctaaatgatggtcaacagctacgaagtgcctgtgctctagaaayggccaatttgatcatgtcacgggataaagtttcaaaatcaataaaaccgtgatgaaatgatcaggaataaacctgtccagaactgttcaagacctaaagg

SEQ ID NO: 84318 - DNA, 201 bp, Homo sapiens
agcctggccaacatagtgaaaccctgtctctactaaaaatacaaaaattagccgggtgtggtggcaaaaagaaaaaaaaatatttacaacaacaggccatmagcccagcagtgggtctagtttgccaaccgctggaaaaagccagcaacattttgggaggccgactgccggctacaggacctcgccataccaacaagggct

SEQ ID NO: 84319 - DNA, 201 bp, Homo sapiens
aaattagccgggtgtggtggcaaaaagaaaaaaaaatatttacaacaacaggccatcagcccagcagtgggtctagtttgccaaccgctggaaaaagccarcaacattttgggaggccgactgccggctacaggacctcgccataccaacaagggctgagacccgcggctctgcagggctctaacaacagcgtttgacctg

SEQ ID NO: 84320 - DNA, 201 bp, Homo sapiens
gcctggacaacagagtgagactctgtctcaaaaaaaaaatatgaatctcccatggcaccacactgaagagtctgatcttgcttttacagaagaggaaaccraggctcagagaggcacacagtcgggattcagaaccagtcccacttgactccaaagcccaggctcttttctccaatacttttcatgtcgcctcttttctct

SEQ ID NO: 84321 - DNA, 201 bp, Homo sapiens
ggtgggagaatcgcttgggccaggaaattgaagctgcagtgatctgtgattgcaccactgcactccagcctgggtgacacagcaagactccgtctcaaaamaaaaaaaaaattatatttggagtacaactctgaatccatatgctaactattcataacattcttagcaccgaggctgtactgggcacccctccggagacga

SEQ ID NO: 84322 - DNA, 201 bp, Homo sapiens
aacccgcccccctacaacagatgagcagggggccagggtgacaactccggagccaggggcagcagcagattctctcctcgcactgttgctggggggctgcracagcgcgaggtgggcagggcactgttcctcccaagccgatccatttttggggacgaacgtgaggtccgggcccaggcttcaggctcattggcactgact

SEQ ID NO: 84323 - DNA, 201 bp, Homo sapiens
gccaaaggaggtgaggtggggcaagggtgtttgcaaaggatagaaaagtctagaatggcagagtatggtgcttaagagtactatgtgacctaggccaagckacttcactctgggtgcctcagtttgctctttaggatggggatgataacaacagcagcacccatctacagagatgccagtgcttgtcaccacgagaagcac

SEQ ID NO: 84324 - DNA, 201 bp, Homo sapiens
gtatttttatgcatttgcctggttgttttatccctgctttccagaactagtgcacagaagggaagaccaccacagactgttcctttattccctgccctggrgccaactgggccaagtggacaagacctcacaagggagagtcaggccagcaatgctcatcccagctccaccctgaccccattcctcttggcatactcagtt

SEQ ID NO: 84325 - DNA, 201 bp, Homo sapiens
ggtgtgtgtgtaggggtgtgcgggcaagggtgtgtgtgcaggggtgtatgtgcaagggtgtgtgtgtctccatgcatgtgtgtgcaggggtgtgtgtgcakgtgtgtgtaggagtgtgtgtgcaggggtgtgtatgcaggggtgtgtgcgcgtagaggtatgtgtgcgtaggggtgtgtgtgcaggggtgtgtgtgcgtgg

SEQ ID NO: 84326 - DNA, 201 bp, Homo sapiens
tgtgtgtgtaggggtgtgcgggcaagggtgtgtgtgcaggggtgtatgtgcaagggtgtgtgtgtctccatgcatgtgtgtgcaggggtgtgtgtgcatgkgtgtgtaggagtgtgtgtgcaggggtgtgtatgcaggggtgtgtgcgcgtagaggtatgtgtgcgtaggggtgtgtgtgcaggggtgtgtgtgcgtgggg

SEQ ID NO: 84327 - DNA, 201 bp, Homo sapiens
atacaaaaaattagccaggtgtggtggtatatgcctgtaatcccagctactcaggaggctgaggcaggagaatcacttgaacccaggaggcggaggttgcrgtgagccaagatcgcaccactgtactctagcctaggcaacagagcaagactccatttcaaaaaaaaaaaaaatgtgttttttaataaagtaagtagagtc

SEQ ID NO: 84328 - DNA, 201 bp, Homo sapiens
tgaggcaggagaatcacttgaacccaggaggcggaggttgcagtgagccaagatcgcaccactgtactctagcctaggcaacagagcaagactccatttcaaaaaaaaaaaaaatgtgttttttaataaagtaagtagagtccgaggtggtggtgggctcttccacaggaccactgcctgagctttcacacctgaccttat

SEQ ID NO: 84329 - DNA, 201 bp, Homo sapiens
gctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctcc

SEQ ID NO: 84330 - DNA, 201 bp, Homo sapiens
gtccatctaagcctttgccccaaaacagtaggtaggtcaggtgcagtggctcatgcctgaaatcttagcactttgggaggctgagatgagaggatcacttraacccaggagttcgagaccagactgggcaacatagcgagatctggtttctaaacacaaaagtaattttaaaaattagccaagcgtggtggcacacacctg

SEQ ID NO: 84331 - DNA, 201 bp, Homo sapiens
ctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctccc

SEQ ID NO: 84332 - DNA, 201 bp, Homo sapiens
taaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtg

SEQ ID NO: 84333 - DNA, 201 bp, Homo sapiens
gcaccagtgaccctgctgctccagctcacagacagcagattccaggacctcccagccttcatacttgcatgagtcaattcccacataaatcccatcttacrcagctggatggagcctattggttctgtttctctgggaaaccctaatacggacccatagatacaaaatcttctatatgcttcttcctcggagaagatccct

SEQ ID NO: 84334 - DNA, 201 bp, Homo sapiens
cttctatatgcttcttcctcggagaagatccctacatcttttatcctctcagcgtggccttgacgcccattctaaagcaaggggagaggttctagtgaggmggaaatagcatggggaccaacaggatggcacgctaggccttcgatggcccttgcagaatgtccagcacgactgccaagtgctcgtcaggtcttttctgga

SEQ ID NO: 84335 - DNA, 201 bp, Homo sapiens
gtgttgtgacgaggctgctggagccccaggcaccatgacgggaatgggtgaatccacccacagtgggtgactctcaatgtgatactagcccggtacacttrgacacccaaaaatcaacgcggcagacgttgtatccccaggagaaggacccccccgaacagacacgtgggacaatggcaagcatggccatccctgaggaca

SEQ ID NO: 84336 - DNA, 201 bp, Homo sapiens
cagagtctgaaaagggaggtgaagcccactttccccacttctggtgtctacaccctcagctcaggacagatgtccagtaacacagctgtggccctgccctrcaactgctgtaataaatgactatttttcatggccctgctctcagatcgctgtgggatccctaaatgtttgtgtgtaactaatctcgttgggcttcaggat

SEQ ID NO: 84337 - DNA, 201 bp, Homo sapiens
gaattatcaaagaaaccattttctctcccggatgaaacccaacctccacttactcctggggaggatccaatggcagttgcaggtggactcagctttgttcwttcactgggaaaggactgtgacgttccacgccttgtctaaactctccagaaaagtggggtgccatgagtgccaatgtccacaccctcaaatcacacagtt

SEQ ID NO: 84338 - DNA, 201 bp, Homo sapiens
tcctgcacagccatagttccagcttttactcactcatcatctgcgtcctccaccagaacgggagtcctgtggttccatgtgtgtggctcactgctcatctytagtgactgggacagtgtctaggactcatatctgtaaatttatttatttattttgagatggagtctccctctgtccccaggctggagtgcagtggcatga

SEQ ID NO: 84339 - DNA, 201 bp, Homo sapiens
ccgaggcaggtggatcacctgagctcaagagtttgagaccaggccaacatggtgaaaccccatctctactaaaaatacaaaaatgacccgggcgtggtggygcacacctacagtcccagctactcaggaggctaaggcaggagaatcgcttgaaccagggaagtgaaggttgcagtgagccgaaatcgcaccactgaactc

SEQ ID NO: 84340 - DNA, 201 bp, Homo sapiens
gtggccactgcatgcatcccaggggccagccctggaggactccacactgcgtagacgcaaacgcggtaactgcaggccggagccgcagacgtcttctgagmgtcatttggttcatttggctctgggtggaattacatgccagtcatttcagaggaattatcaaagaaaccattttctctcccggatgaaacccaacctcca

SEQ ID NO: 84341 - DNA, 201 bp, Homo sapiens
atttccgtatttttagtagagacggggtttcaccctgttggccaggctggcctcgaactcatgacctcaagtgatccacctgcctcggcctctcacagtgstgggattacaggtatgagcaaacgcgcccagcctcatatttgtaaattaaatattttataagagcaggtcaatctttttctggggaaaaaaaaaaaaata

SEQ ID NO: 84342 - DNA, 201 bp, Homo sapiens
gcctctaaaaataccctccatgacacgctgtgtgctgccagaggcttggttttcgccctcttctccccaactcttagccacgtcccagtggtggcgggggracgggggtcccaagccactgcactgggttttggtttcactatgttgcccaggctggagtgcagtggtgcgatctcagcttactgcaacctccaccttccg

SEQ ID NO: 84343 - DNA, 201 bp, Homo sapiens
tgcctcggcctctcacagtgctgggattacaggtatgagcaaacgcgcccagcctcatatttgtaaattaaatattttataagagcaggtcaatctttttytggggaaaaaaaaaaaaataggaaaaaaaaaaaaagagcaataaacgggatctttcccacacctacatcccagctgtgccaaaagcactttttgacaccc

SEQ ID NO: 84344 - DNA, 201 bp, Homo sapiens
tgagttctagcctctaaaaataccctccatgacacgctgtgtgctgccagaggcttggttttcgccctcttctccccaactcttagccacgtcccagtggyggcggggggacgggggtcccaagccactgcactgggttttggtttcactatgttgcccaggctggagtgcagtggtgcgatctcagcttactgcaacctc

SEQ ID NO: 84345 - DNA, 201 bp, Homo sapiens
gcttgaatcttgttaacagttaggctctgattcaatagtctgggtggggcccaagactctgcatttctttttcttttcttttttcttttttgagacggagkcttgctctgttgcccaggctggagtgcagtggtgcaatctcagctcactgcaacctccccctcctgggttcatgcaattctcttgcctcagcctcccaag

SEQ ID NO: 84346 - DNA, 201 bp, Homo sapiens
gtctccagatgactgagctagaccacccagaacacattacagggaggcagaagctgacaggagggcaggaagcactgtctccagggctgtcttgaaatcaytgggctgactttgtaggtagtgagacgcccatcactggaggcatccgaaccaagcccagataaaacaaacatcagaaacatttttaactccgtttctctg

SEQ ID NO: 84347 - DNA, 201 bp, Homo sapiens
gtggcaatgaagaccagtggccactgcatgcatcccaggggccagccctggaggactccacactgcgtagacgcaaacgcggtaactgcaggccggagccrcagacgtcttctgagcgtcatttggttcatttggctctgggtggaattacatgccagtcatttcagaggaattatcaaagaaaccattttctctcccgga

SEQ ID NO: 84348 - DNA, 201 bp, Homo sapiens
agactggttacaaactcctgacctcaggtgatccacccgcctcggcctcccaaagtgctgggattccaggcatgagccaccatgcccagcctgcactgggktttggactggctgtgttagcatcacctggggcaggggtgggtcacgttagaatgagtcctggctaggcccacagcaggcttttccacccgaatactgggg

SEQ ID NO: 84349 - DNA, 201 bp, Homo sapiens
acgccaaggggtccccatgttctcaacatgggtcattcctgggagtcgggtgggggcttcacacatgtgccaaagaccctactggcccacatcactagtgsgtggggggcattctgatgctgcagctgggtcagagtcagcccagagcacccacagtggcaatgaagaccagtggccactgcatgcatcccaggggccagc

SEQ ID NO: 84350 - DNA, 201 bp, Homo sapiens
aagccctttgtcctgggctggaaggaccctggaaaggttatctggtccctgactcagggaagggaggcattctccctgcaggaatgttctcgatcacagtmcaccaccacccccctacccccgcccacttttggagtccatcttcgcagcccttgatgattcattttatgtcagcttgacgggctaagggatgctcagata

SEQ ID NO: 84351 - DNA, 201 bp, Homo sapiens
ggagaacgccaaggggtccccatgttctcaacatgggtcattcctgggagtcgggtgggggcttcacacatgtgccaaagaccctactggcccacatcacyagtgggtggggggcattctgatgctgcagctgggtcagagtcagcccagagcacccacagtggcaatgaagaccagtggccactgcatgcatcccagggg

SEQ ID NO: 84352 - DNA, 201 bp, Homo sapiens
gtaactaatctcgttgggcttcaggatcacagtaaagacagcttagaaacatggaagctctccattcgggcagcacctccttcttttagcaggatggggcygacctcgccagctggagcagcagaagtggccacaaacgccaccagggatggcagacggtgatccaggaaggggctgtgctcacaaggaccccagacctgc

SEQ ID NO: 84353 - DNA, 201 bp, Homo sapiens
cactagaagcttccagcatcctccacaaatttgacaactgagaaatgtggctgggaaatcatgatttgggtccgaagaagtgaaagcaacaatcctcaggktgttgtttcttgagagaagaaggtaaacagcaggaattcggctgaggtgtccaaatctcggggaggatgaattctcaggagagctgaacctgagacaaag

SEQ ID NO: 84354 - DNA, 201 bp, Homo sapiens
  misc_feature (1)...(201): n = A,T,C or G, or insertion/deletion polymorphism (see Tables 1-2)
ggaggccgaggagggtggatcaccagaggtcagaagttcgagaccagcctgaccaatatggagaaacaccgtctctactaaaaatacaaaattagctaggngtggtggtgcatgcctgtaatcccagctgctcgggtggctgaggcaggagaatcgcttgaacccaggaagcaaaggttgtggtgagccaagatggtgcca

SEQ ID NO: 84355 - DNA, 201 bp, Homo sapiens
gccttctcgaggcctgtttcctcattggtgaaatgctaagccccactcagcgtggacagcccacaatgctaaaattctgctgctaacattctgggccgggygcagtggctcacgcctgtaatcccagcactttgggagcccaaggtgggtggatcacttgaggtcaggagttcaagaccagcctggccaacatagtgaaac

SEQ ID NO: 84356 - DNA, 201 bp, Homo sapiens
cccacaatgctaaaattctgctgctaacattctgggccgggcgcagtggctcacgcctgtaatcccagcactttgggagcccaaggtgggtggatcacttsaggtcaggagttcaagaccagcctggccaacatagtgaaaccccatctctactaaaaatacaaaaattagccaggcatggtggcacacgcctgtagtcgc

SEQ ID NO: 84357 - DNA, 201 bp, Homo sapiens
aacatagtgaaaccccatctctactaaaaatacaaaaattagccaggcatggtggcacacgcctgtagtcgccactatttgggaggctgaggcaggagaaytgcttgagcccgggagacacagactgcagtgagccaagatcacgccactgcactccagcctgggcgacaggacgagacttcgtctcaaaataataataat

SEQ ID NO: 84358 - DNA, 201 bp, Homo sapiens
ggctggagtgcagtggtatgatctccgctcactgcagtctccacctcctggggtcaagcgattctcccacctcagcctcccaagtagctgggattacaggygcctgccaccacacctggctaatttttgtatttttagtagagatggagtttcgtcatgttggccaggctggtcttgaactcctgacctcaagtgatccac

SEQ ID NO: 84359 - DNA, 201 bp, Homo sapiens
gagttttggagctgacagctctggggtggagtcagtctctgataccttttatttatttatttatttatttatttatttatttatttatttaaatgaatttwtttttttttttgagacggagactcgctctgtcacccaggcttggagtgcagtggcgcaatctctgctcactgcaacctccgcctccagggttcaagcaat

SEQ ID NO: 84360 - DNA, 201 bp, Homo sapiens
cttggagtgcagtggcgcaatctctgctcactgcaacctccgcctccagggttcaagcaattctcctgcctcagcctcccgagcagctgggactaaaggcdcatgccaccatgcccagctaatttttgtatttttagtagagatggggtttcaccatgttggccaggatggtctcgatctcctgacctcgtgatccacccg

SEQ ID NO: 84361 - DNA, 201 bp, Homo sapiens
cgcatgccaccatgcccagctaatttttgtatttttagtagagatggggtttcaccatgttggccaggatggtctcgatctcctgacctcgtgatccaccygcctcggcctcccaaagtgctgggattacaggtgtgagccaccacgcccagccctgactgtgatactttttagctgtgtgaccttgaggaagtggtttct

SEQ ID NO: 84362 - DNA, 201 bp, Homo sapiens
gctgcaaaagggacctacgtggtatggggagcagggacaggtcttggtgttcccagccccagggacctcagaggctactggccccctcccctcagcctggmcccgggtccaggtgtgatacccaccttgaagacctttggtggcgaagtgcaggtcgatggggtgggaccagtaagccatgtcccctatctgcggggtgtc

SEQ ID NO: 84363 - DNA, 201 bp, Homo sapiens
cacgcccagccctgactgtgatactttttagctgtgtgaccttgaggaagtggtttctccccctaggtttgtttcctcctctgtaaaataggtcctaaccrcattcctctctcatgtagcatcatctctcaagtcgactaaggctggcaccaaggggaaccactctgtttgctctggccttccttgccccaaatgcaagag

SEQ ID NO: 84364 - DNA, 201 bp, Homo sapiens; identical to SEQ ID NO: 72579

SEQ ID NO: 84365 - DNA, 201 bp, Homo sapiens; identical to SEQ ID NO: 72582

SEQ ID NO: 84366 - DNA, 201 bp, Homo sapiens; identical to SEQ ID NO: 72586

SEQ ID NO: 84367 - DNA, 201 bp, Homo sapiens; identical to SEQ ID NO: 48193

SEQ ID NO: 84368 - DNA, 201 bp, Homo sapiens; identical to SEQ ID NO: 8961

SEQ ID NO: 84369 - DNA, 201 bp, Homo sapiens; identical to SEQ ID NO: 48195

SEQ ID NO: 84370 - DNA, 201 bp, Homo sapiens
gttaacaccctctttctgaatgtcagtttcctgttattctttgaaaaacagcaataacattaagctccctgcattcccacacagactctcctaatttaagygctgtgtaaccttgggcaagtgaattcctctctctgagccaggtgtaagacaagacagagtgactctagaacccattccagtattatagtgggaaattag

SEQ ID NO: 84371 - DNA, 201 bp, Homo sapiens
cgcccgtagctggggtgaggagggcgggaggcgccgcagccaggagggcggggaccagacctgccccgtctcgccccgggctccgcgagcgatccccgccyccgccgggggcatgggaaggaaagggaagggaggaggatgaggccgccggacgctggggtttccccagccaccctgagaggaactgggactttggggtcc

SEQ ID NO: 84372 - DNA, 201 bp, Homo sapiens
gcagccaggagggcggggaccagacctgccccgtctcgccccgggctccgcgagcgatccccgcccccgccgggggcatgggaaggaaagggaagggaggrggatgaggccgccggacgctggggtttccccagccaccctgagaggaactgggactttggggtccagactgccagcgtttagcgcagcggggtcctcctg

SEQ ID NO: 84373 - DNA, 201 bp, Homo sapiens
gcttctcccacaccaggctcccttctctgcacctggcaccccacgaccccccccccattcaacgcgtcctggaagagggagccttctaccctccccctatygcttgtctccctctaggggactgcccccacgaccccgcatgtttctgtcgcactctagaagcggtccacttcgctatctcctcctctccaagaccagaca

SEQ ID NO: 84374 - DNA, 201 bp, Homo sapiens
cttctcccacaccaggctcccttctctgcacctggcaccccacgaccccccccccattcaacgcgtcctggaagagggagccttctaccctccccctattkcttgtctccctctaggggactgcccccacgaccccgcatgtttctgtcgcactctagaagcggtccacttcgctatctcctcctctccaagaccagacac

SEQ ID NO: 84375 - DNA, 201 bp, Homo sapiens
ttcctccagccagtttcttctgccagtcacttcctacccgtggccccggcactccggcgccccctgggggcccccctcccggctcccctgcccctccgagytcaccgttgtgggtttccaccattagcacgcgggtgacctccttggcgtagtagtcggcctcaggctcgggctccggttctgcactctccccggccaccc

SEQ ID NO: 84376 - DNA, 201 bp, Homo sapiens
cagggcgagcacggcctcgggcagcgggccgggcggcacctccccctggctcggggggctggcgagccgcagcttggacaggatctggccgcggatggccycgatgcgcttccgcttcaccagctccatgtcgatagtcttgcaggtggatagtcccgcggccggccggccaggcgtcagcaccagtagccacagcagcgg

SEQ ID NO: 84377 - DNA, 201 bp, Homo sapiens
gggctggtgtggtggggaggccccgcccctgcaggggctgggggtctcccggcaaaaggtaggagggcctcgagggaaagctgaggtcctcagggagaagrgcgcagtggtggaggggaggcttggaccgggggtgtctcagtatcccacggaaataacctagatgggcgcgatctggtaccagaaggtgggtggtcttga

SEQ ID NO: 84378 - DNA, 201 bp, Homo sapiens
tggtggaggggaggcttggaccgggggtgtctcagtatcccacggaaataacctagatgggcgcgatctggtaccagaaggtgggtggtcttgaatagggkatctgtggcaggtcggagagagatccgtctcctggaggagaaagggtctaggatgcgcgggggctcaggagacaggccggggatgaaggcggcgtgcagg

SEQ ID NO: 84379 - DNA, 201 bp, Homo sapiens
cccgctcacaccacctttcccacgcctgtctcccctctcggtaaagcccttcccatgacccaggactctaggtcttctggaagctcgattcctccgctggkctccccactctgtccctcacgtccctgtgtgaaacaccgaggacacctctgcatcccgggcgccctcccgagtctccgctcctctcccgcttgcctcctc

SEQ ID NO: 84380 - DNA, 201 bp, Homo sapiens
tgtctcagtatcccacggaaataacctagatgggcgcgatctggtaccagaaggtgggtggtcttgaataggggatctgtggcaggtcggagagagatccktctcctggaggagaaagggtctaggatgcgcgggggctcaggagacaggccggggatgaaggcggcgtgcagggggtgcgcccgaggtctggggaaaagt

SEQ ID NO: 84381 - DNA, 201 bp, Homo sapiens
cactggaacccaggaggcggagattgcagtgagctgaggtcataccactgcactccagcttggcaacagagtgagacactgtctcaaaaaaaaaaaaaagmgttctaggattgtatggtttgtgttcttctatccttcagggaccatctaggtggaccttgtaaccagccgacccacagccacccccttggtcacagctca

SEQ ID NO: 84382 - DNA, 201 bp, Homo sapiens; identical to SEQ ID NO: 48204

SEQ ID NO: 84383 - DNA, 201 bp, Homo sapiens; identical to SEQ ID NO: 48209

SEQ ID NO: 84384 - DNA, 201 bp, Homo sapiens; identical to SEQ ID NO: 8958

SEQ ID NO: 84385 - DNA, 201 bp, Homo sapiens
atgggtgtggtggcacatgcctgtggtgtcagctatttgggaagctgaggcaggagcatcacttgaacctgggaggcagcagttgcagtgagccgagatcrcgccaccgcacttcagcctgggcgacagagccagacttctactctcaaaaaagaaaaaaaagaaaagaaaggaaaatatgattaactatagagtttattc

SEQ ID NO: 84386 - DNA, 201 bp, Homo sapiens; identical to SEQ ID NO: 8959

SEQ ID NO: 84387 - DNA, 201 bp, Homo sapiens; identical to SEQ ID NO: 75713

SEQ ID NO: 84388 - DNA, 201 bp, Homo sapiens; identical to SEQ ID NO: 8963

SEQ ID NO: 84389 - DNA, 201 bp, Homo sapiens
gagggcttcctggaggtggagtctagcctggcactcagggtgggtggaaactgatcgtcattttgcccacaggaatcctcgtagcccactacctccagagyatcacgccttgcctggccctgggtggagagctggtctaccaccggcggcctggagaggagggcactgtcatgtctctagctgggaaatacacatgtgagc

SEQ ID NO: 84390 - DNA, 201 bp, Homo sapiens
gagaaagggtctaggatgcgcgggggctcaggagacaggccggggatgaaggcggcgtgcagggggtgcgcccgaggtctggggaaaagtctttgcgggargccgggtcggcgactcccgagggctggtccggaatgggggcgcctgagggacgccgtgtagggggcagggagggagcaagcgtccccggcggcaaaggga

SEQ ID NO: 84391 - DNA, 201 bp, Homo sapiens
cgggccgaggccggccccgcgggcggctcagagccgggggggtgccccggacggggcgtcccccctgcccccggccggggccctcgctgtctggctgctcsgcggagggaggtgggagggagatggcccagggcgcgaagggcggcggcggcggggaccggctgggtcggcagggggttttgaagccgcccccggccccac

SEQ ID NO: 84392 - DNA, 201 bp, Homo sapiens
cgaggccggccccgcgggcggctcagagccgggggggtgccccggacggggcgtcccccctgcccccggccggggccctcgctgtctggctgctccgcggwgggaggtgggagggagatggcccagggcgcgaagggcggcggcggcggggaccggctgggtcggcagggggttttgaagccgcccccggccccacccagg

SEQ ID NO: 84393 - DNA, 201 bp, Homo sapiens
gaggccggccccgcgggcggctcagagccgggggggtgccccggacggggcgtcccccctgcccccggccggggccctcgctgtctggctgctccgcggarggaggtgggagggagatggcccagggcgcgaagggcggcggcggcggggaccggctgggtcggcagggggttttgaagccgcccccggccccacccagga

SEQ ID NO: 84394 - DNA, 201 bp, Homo sapiens
gagccgggggggtgccccggacggggcgtcccccctgcccccggccggggccctcgctgtctggctgctccgcggagggaggtgggagggagatggcccakggcgcgaagggcggcggcggcggggaccggctgggtcggcagggggttttgaagccgcccccggccccacccaggaagcgcacggggcgggagcgggggc

SEQ ID NO: 84395 - DNA, 201 bp, Homo sapiens
aggcttaatccgggggatgagacacaggggagccgaccagaggagggggacccagaacggaaggagagtcaggctgggaaacaaggtaggagaagagggtytgtcaacatgggggcctccggagggtgtcagtgggaggagggggcaacaggacacctgagggatggaagggtcaggaggcagacacctgtaagaattgct

SEQ ID NO: 84396 - DNA, 201 bp, Homo sapiens
gtaaataagcaaattatagggtagattagatggtggtaattgctgtgagggaaaacagagctgggtagggtgagggtggggataccgctttagcaagaagrggatcaaggaagcttcattaagaaggtgacatttgagcaaatgctaaaaggaaggaagggagtaggccatgtggccatctagaggaagagtgctcctagc

SEQ ID NO: 84397 - DNA, 201 bp, Homo sapiens
aagcttcattaagaaggtgacatttgagcaaatgctaaaaggaaggaagggagtaggccatgtggccatctagaggaagagtgctcctagccagagggaayagcaagtgccaaggccctggggggggactgtctggtggggacagtatggctggagcccagacggagtgtgcctggtggggacagcatggctagagcagaa

SEQ ID NO: 84398 - DNA, 201 bp, Homo sapiens
ggactccagagacaagattcttgtcatagtccatgtgagagaagaacttggacagatcaaggtgctgggcgagaaaagggtaagaagtgggatttaggatrtatttcaaaagtagaggcagtttaagatttcctgatggacaaaatgggggcttgagaaaagagaaagcaaggctggtgccaccactgggggactggaggc

SEQ ID NO: 84399 - DNA, 201 bp, Homo sapiens
acaggctgttccctttgcctggaatcttttttttttttttttttttttgagatgggatctcactctttcatgtaggctggattgcagtagtgtgattatgrctcactgcagcctcgacctcccaggctcaggtgattctcccacctcagtctcccaagcagctggaactacaggcacgtaacagcatgcatggctaatttt

SEQ ID NO: 84400 - DNA, 201 bp, Homo sapiens; identical to SEQ ID NO: 72617

SEQ ID NO: 84401 - DNA, 201 bp, Homo sapiens; identical to SEQ ID NO: 72618

SEQ ID NO: 84402 - DNA, 201 bp, Homo sapiens; identical to SEQ ID NO: 48223

SEQ ID NO: 84403 - DNA, 201 bp, Homo sapiens
ttctaggctcctacaatgtgccgaagcctgtgctgtgtgcttgggactcagcattgaccaagacagatgagctccttctaggcctttgtcgaacagcccakgacactcctcccagtgcccacctgctccctaatccctattttttctttttcttttctttttttttttttgagacggagtttcactgttgttgcccaggct

SEQ ID NO: 84404 - DNA, 201 bp, Homo sapiens
tgccaacccatgaaagcctggaaaaaatggggggacccttgtctggggaaccagcatttaactctgggaagtccaaaataaccttttcgggttcaggtcgycggaaagccccgcccgaaggggctatggctccgcccacgagcgcaaaagacccgccttccgcgtcacgtcagccaccccgcttccctcccccagcaagct

SEQ ID NO: 84405 - DNA, 201 bp, Homo sapiens; identical to SEQ ID NO: 48226

SEQ ID NO: 84406 - DNA, 201 bp, Homo sapiens; identical to SEQ ID NO: 48228

SEQ ID NO: 84407 - DNA, 201 bp, Homo sapiens
actttgggaggccgaggtggattgattacttgaggtcgggagttcgagaccagcctggccaacatggtgaaaccccgtttctactaaaaatacaaaaattrgccaggcatggtgccggacggctctaatcccagctacttgggaggttgaggcatgagaatcgcttgaacctgagaggcagaggttatagtgtgccgagat

SEQ ID NO: 84408 - DNA, 201 bp, Homo sapiens; identical to SEQ ID NO: 8956

SEQ ID NO: 84409 - DNA, 201 bp, Homo sapiens; identical to SEQ ID NO: 48229

SEQ ID NO: 84410 - DNA, 201 bp, Homo sapiens; identical to SEQ ID NO: 48233

SEQ ID NO: 84411 - DNA, 201 bp, Homo sapiens; identical to SEQ ID NO: 48234

SEQ ID NO: 84412 - DNA, 201 bp, Homo sapiens; identical to SEQ ID NO: 48235

SEQ ID NO: 84413 - DNA, 201 bp, Homo sapiens; identical to SEQ ID NO: 48236
  misc_feature (1)...(201): n = A,T,C or G, or insertion/deletion polymorphism (see Tables 1-2)

SEQ ID NO: 84414 - DNA, 201 bp, Homo sapiens; identical to SEQ ID NO: 48238

SEQ ID NO: 84415 - DNA, 201 bp, Homo sapiens; identical to SEQ ID NO: 8964

SEQ ID NO: 84416 - DNA, 201 bp, Homo sapiens; identical to SEQ ID NO: 48239

SEQ ID NO: 84417 - DNA, 201 bp, Homo sapiens
tgaaaggttagagctgcccacctcacccacacagcaccggaaagattttttttttccccagctccagcttaaaagacagaaagattatttaaaagtgaaayctcagccaggcgcggtggctcatgcctgtaatcccagcactttgggaggccgaggcaggtggatcacctgaggtcaggagttcgagaccagcctgaccac

SEQ ID NO: 84418 - DNA, 201 bp, Homo sapiens
aaaacctcgtctctactaaaaatacaaaaattagtctggagtggtggcaggtgcctgtaatcccaggtactcgggaggctgaggcacgagaatcgctggaraagctgcagtgagccgagattgcaccactgcactccagctggtgtgacacagtgagactccatctcaaaaaatgaacaaacaagccaggcgcagtgactc

SEQ ID NO: 84419 - DNA, 201 bp, Homo sapiens
tgggcgcagtggctcacatctgtaatcctagcactttgggaagccaaggcaggtggatcacttgaggtcaggggttcgagaccagcctggccaaaatggtraaactctgtctctactaaaaacacacacacacacacccacaaaattagccacgtctgtaatcccagcactttgggagactaaggcaggcagatcacaagg

SEQ ID NO: 84420 - DNA, 201 bp, Homo sapiens; identical to SEQ ID NO: 72637

SEQ ID NO: 84421 - DNA, 201 bp, Homo sapiens
ggttgcagtgagccaagatggtcccattgcactccagcctgggcaacaagagcgaaattccatctaaaaaaaaaaagaaaagaaaaaaagaaaatgcaccragtactaactaaatcccagatgctatgctaagtactttaagcatccattcatttaatccaccctctaggactcttaatcccctcctcaccccccagttta

SEQ ID NO: 84422 - DNA, 201 bp, Homo sapiens; identical to SEQ ID NO: 48240

SEQ ID NO: 84423 - DNA, 201 bp, Homo sapiens; identical to SEQ ID NO: 72639

SEQ ID NO: 84424 - DNA, 201 bp, Homo sapiens
caggatcaagcaatcctcccacctcaacctcccaagtagttgggacgacaggcacacagcactatgctttgctaattttttatttatttgtagagacgggkgtctcactatgttgcccaggctggtctcaaactcctgggctcaagtgatcctcctgctccagtctcccaaagtgctggcattacaggggtgagtcaccac

SEQ ID NO: 84425 - DNA, 201 bp, Homo sapiens
tttttttgacagagtctccctctgtcgcccaggctggagtgcagtggcatgatctctgctcaccacaacctccgcctcccaggttcaagcaattcttctgyctcagcctccttagtagctgggattgcaggcacccaccactatatctagctaatgtttgtgcttttagtagagatggagttccaccatgttggtcaggct

SEQ ID NO: 84426 - DNA, 201 bp, Homo sapiens
ttgaggccggattcggtggttcatgcccgtaatcccagcactttgggaggccaaggagagtggataccctgaggtcaggagttcgagaccagcctggccamcatatagcgaaaccctgtctctactaaaaaataccaaaactagatgggtgtggtggcacatgcctgtggtgtcagctatttgggaagctgaggcaggagc

SEQ ID NO: 84427 - DNA, 201 bp, Homo sapiens; identical to SEQ ID NO: 75739

SEQ ID NO: 84428 - DNA, 201 bp, Homo sapiens
atggcggcgggcgcctgtaatcccaagtactcgggaggctgaggcaggagaatcacttgaacctgggaggcggaggttgcagtgatctgagatcgtgccaytgcactccatcctgggggacaagagtgagacaaagtctcaaaaacaaaacaaaacaacaacaaacagatcttgctctgttacccaggctggagtgcagtg

SEQ ID NO: 84429 - DNA, 201 bp, Homo sapiens
cctgtaatcccaagtactcgggaggctgaggcaggagaatcacttgaacctgggaggcggaggttgcagtgatctgagatcgtgccattgcactccatccygggggacaagagtgagacaaagtctcaaaaacaaaacaaaacaacaacaaacagatcttgctctgttacccaggctggagtgcagtggcacaatcacagc

SEQ ID NO: 84430 - DNA, 201 bp, Homo sapiens
gggattacaggtgtgaaccaccatgcctggcccactatcctctccttccttccttccttccttccttccttccttccttccttccttccttccttccttcyttccttctttccttccttccttctttccttcctccctccctccctcctttctctctctctttctttctttctgttgctctgtctccaggctggagtgcag

SEQ ID NO: 84431 - DNA, 201 bp, Homo sapiens; identical to SEQ ID NO: 72646

SEQ ID NO: 84432 - DNA, 201 bp, Homo sapiens; identical to SEQ ID NO: 72648

SEQ ID NO: 84433 - DNA, 201 bp, Homo sapiens; identical to SEQ ID NO: 48251

SEQ ID NO: 84434 - DNA, 201 bp, Homo sapiens; identical to SEQ ID NO: 75755

SEQ ID NO: 84435 - DNA, 201 bp, Homo sapiens; identical to SEQ ID NO: 72655

SEQ ID NO: 84436 - DNA, 201 bp, Homo sapiens; identical to SEQ ID NO: 72654

SEQ ID NO: 84437 - DNA, 201 bp, Homo sapiens; identical to SEQ ID NO: 72656

SEQ ID NO: 84438 - DNA, 201 bp, Homo sapiens; identical to SEQ ID NO: 72657

SEQ ID NO: 84439 - DNA, 201 bp, Homo sapiens; identical to SEQ ID NO: 72658

SEQ ID NO: 84440 - DNA, 201 bp, Homo sapiens; identical to SEQ ID NO: 8962

SEQ ID NO: 84441 - DNA, 201 bp, Homo sapiens; identical to SEQ ID NO: 72659

SEQ ID NO: 84442 - DNA, 201 bp, Homo sapiens; identical to SEQ ID NO: 72662

SEQ ID NO: 84443 - DNA, 201 bp, Homo sapiens; identical to SEQ ID NO: 72664

SEQ ID NO: 84444 - DNA, 201 bp, Homo sapiens; identical to SEQ ID NO: 72665

SEQ ID NO: 84445 - DNA, 201 bp, Homo sapiens; identical to SEQ ID NO: 72551

SEQ ID NO: 84446 - DNA, 201 bp, Homo sapiens
accattagcacgcgggtgacctccttggcgtagtagtcggcctcaggctcgggctccggttctgcactctccccggccacccggtcgcgggtgctgttgtrcagggcgagcacggcctcgggcagcgggccgggcggcacctccccctggctcggggggctggcgagccgcagcttggacaggatctggccgcggatggcc

SEQ ID NO: 84447 - DNA, 201 bp, Homo sapiens
aggtgtgaaccaccatgcctggcccactatcctctccttccttccttccttccttccttccttccttccttccttccttccttccttccttccttccttcyttccttccttccttctttccttcctccctccctccctcctttctctctctctttctttctttctgttgctctgtctccaggctggagtgcagtggcacaa

SEQ ID NO: 84448 - DNA, 201 bp, Homo sapiens
accaccatgcctggcccactatcctctccttccttccttccttccttccttccttccttccttccttccttccttccttccttccttccttctttccttcyttccttctttccttcctccctccctccctcctttctctctctctttctttctttctgttgctctgtctccaggctggagtgcagtggcacaatcttggct

SEQ ID NO: 84449 - DNA, 201 bp, Homo sapiens; identical to SEQ ID NO: 48175

SEQ ID NO: 84450 - DNA, 201 bp, Homo sapiens
atctcagcccttgttgtgccgacactgatgtgggaggattcaaactacaaacaagaaaaatacatggtatgtttaaggccgggtgcagtggctcacgcctrtaatcccagcactttgggaggccaaggcgggcagatcacttgaggtcaggagtttgagaccagcctgggcaacatggtgaaactccgtctctactaaaag

SEQ ID NO: 84451 - DNA, 201 bp, Homo sapiens; identical to SEQ ID NO: 48178

SEQ ID NO: 84452 - DNA, 201 bp, Homo sapiens
ctgatgtgggaggattcaaactacaaacaagaaaaatacatggtatgtttaaggccgggtgcagtggctcacgcctataatcccagcactttgggaggccraggcgggcagatcacttgaggtcaggagtttgagaccagcctgggcaacatggtgaaactccgtctctactaaaagtacaaaaattagctgggcatggtg

SEQ ID NO: 84453 - DNA, 201 bp, Homo sapiens
gaggattcaaactacaaacaagaaaaatacatggtatgtttaaggccgggtgcagtggctcacgcctataatcccagcactttgggaggccaaggcgggcrgatcacttgaggtcaggagtttgagaccagcctgggcaacatggtgaaactccgtctctactaaaagtacaaaaattagctgggcatggtggcaggttcc

SEQ ID NO: 84454 - DNA, 201 bp, Homo sapiens; identical to SEQ ID NO: 48181

SEQ ID NO: 84455 - DNA, 201 bp, Homo sapiens
caaactacaaacaagaaaaatacatggtatgtttaaggccgggtgcagtggctcacgcctataatcccagcactttgggaggccaaggcgggcagatcacktgaggtcaggagtttgagaccagcctgggcaacatggtgaaactccgtctctactaaaagtacaaaaattagctgggcatggtggcaggttcctataatc

SEQ ID NO: 84456 - DNA, 201 bp, Homo sapiens; identical to SEQ ID NO: 48182

SEQ ID NO: 84457 - DNA, 201 bp, Homo sapiens; identical to SEQ ID NO: 48184

SEQ ID NO: 84458 - DNA, 201 bp, Homo sapiens; identical to SEQ ID NO: 48186

SEQ ID NO: 84459 - DNA, 201 bp, Homo sapiens; identical to SEQ ID NO: 48187

SEQ ID NO: 84460 - DNA, 201 bp, Homo sapiens; identical to SEQ ID NO: 48188

SEQ ID NO: 84461 - DNA, 201 bp, Homo sapiens
cgcagcttggacaggatctggccgcggatggcctcgatgcgcttccgcttcaccagctccatgtcgatagtcttgcaggtggatagtcccgcggccggccsgccaggcgtcagcaccagtagccacagcagcggtagcagcagcagcagcagccgcagcccggagggcggcatgggggaggcggcgccccccggcactgcc

SEQ ID NO: 84462 - DNA, 201 bp, Homo sapiens; identical to SEQ ID NO: 48189

SEQ ID NO: 84463 - DNA, 201 bp, Homo sapiens; identical to SEQ ID NO: 48192

SEQ ID NO: 84464 - DNA, 201 bp, Homo sapiens
aggagagtcaggctgggaaacaaggtaggagaagagggtctgtcaacatgggggcctccggagggtgtcagtgggaggagggggcaacaggacacctgagrgatggaagggtcaggaggcagacacctgtaagaattgctctcctttactgagcacctcccatgtggctaagcagcctcctgtcactcaacaccctgcgac

SEQ ID NO: 84465 - DNA, 201 bp, Homo sapiens
tctgctcatagattggtggggccagccaggcacggtggctcacgcctgtcatcccggcactttgggaggctagggcaggcagacttgaggaccctgtcttyactaaaaattcaaaaattagctggacctggtggcgggcacctgtaatcccagctactggggagtctgaggcaggagaatcgcttgaacccaacttcaagt

SEQ ID NO: 84466 - DNA, 201 bp, Homo sapiens
gaaggctgaggcgggaagagctcttgaggccagaagttcgaatatagggagaccccattaataatgcatatatcaactagtgaagtattccgttgaattgwttaatataaatgttatcctattgaaatgttgtaccctcgttataattttggttttttactttttgagatggcgtctccccctgtcatccaggctggagtg

SEQ ID NO: 84467 - DNA, 201 bp, Homo sapiens
gggtggaggaaggagcatgtagcctctaggctaggggtcttggtgtggaaatgaaccaggcttgggggaatacctgtgtgaatgccccacttgcagaagargctactttccgagaaaccgctggcccccatgatctgcccgatcacgtgcacctcagccatggccctgggaggggaaaaatataatcacaaccctgtgagg

SEQ ID NO: 84468 - DNA, 201 bp, Homo sapiens; identical to SEQ ID NO: 72587

SEQ ID NO: 84469 - DNA, 201 bp, Homo sapiens; identical to SEQ ID NO: 72588

SEQ ID NO: 84470 - DNA, 201 bp, Homo sapiens
agagacagaggtctcactatgttgcccaggctgggctcaagcaatcctcctgccctggcctcccgaagtgctgggattacaggcatgagccactgcacccrgccagcatcaatctcttgaatgaatgagtgaatgatgttttctaggctcctacaatgtgccgaagcctgtgctgtgtgcttgggactcagcattgaccaa

SEQ ID NO: 84471 - DNA, 201 bp, Homo sapiens
ctctaatcccagctacttgggaggttgaggcatgagaatcgcttgaacctgagaggcagaggttatagtgtgccgagattgcgccactgcactccagcctkggtgacagagtaagactctgtctcaaaaacaacaacaacaaaaaaccacaaaacagcgctatttaccagatgctatctaaagcactttacaaagatgaag

SEQ ID NO: 84472 - DNA, 201 bp, Homo sapiens
ctgaatggcgcttcgggattctgagtagcaggggcagcatgcccagtgggcctggggtcccgggagggattccagaattgaggggcacgcaggattctgaycaccaggggcagaggcggccagacaacctcagggaggagtgtcctggcgtccccatcctccaaagggcctgggcccgccccgagggggcagcgagaggag

SEQ ID NO: 84473 - DNA, 201 bp, Homo sapiens
cactaatccattaacccattaatccatgaatgggtaatgagcatagtgagcacgggataagtcttcaatatcattttattacgattctcaccccatatttwcaagcctagtccaaggattaagatggggccaagggtaccctccaggagcgcatcctgaaacacacataacaatttcgatcctactgaggggtgataatga

SEQ ID NO: 84474 - DNA, 201 bp, Homo sapiens
cccggcactttgggaggctagggcaggcagacttgaggaccctgtctttactaaaaattcaaaaattagctggacctggtggcgggcacctgtaatcccasctactggggagtctgaggcaggagaatcgcttgaacccaacttcaagtggcaccggataacctagaggcaagataaagcctttccaagagccacagaagc

SEQ ID NO: 84475 - DNA, 201 bp, Homo sapiens
acaggaagttctgaactcacaaaaggggaagaactagtgtccggaatctttttttttttttgagatggagtttccctcctgttgcccaggctggagtgcgrtggtgtgatctcagctcactgcaacctccgtctcccgggttcaagcaattctcctgcctcagcctctcaagtacctgggattacaggcatgtgccaccat

SEQ ID NO: 84476 - DNA, 201 bp, Homo sapiens
cccaggctggagtgcgatggtgtgatctcagctcactgcaacctccgtctcccgggttcaagcaattctcctgcctcagcctctcaagtacctgggattayaggcatgtgccaccatgcctggctaattttttgtatttttagtagaggctgggtttcaccatgttggtcaggctggtctcaaactcctgacctcaggtga

SEQ ID NO: 84477 - DNA, 201 bp, Homo sapiens
aagccaacctcccacctcagcctcctgagtagctgggacaaaaggtacacaccaccaggcccagctacttttcatatttttttttttgggagatggggttkcaccatattgcccaggctggtctccaactcttaggctcaagcaatcctcctgccttggcctcccaaagtggtgggattatagctgtgagccactgcagcc

SEQ ID NO: 84478 - DNA, 201 bp, Homo sapiens
tagtacagacagggtttcaccatgttggccaggctggtctccaactcctgacctcaagtgatccacctgcctcagcctcccaaagtgctgggattacgggygtgagctaccatacctggcctctcttaggacttttttcaaaatctacaaaatcatctctctctctctctgtatatatattcagggtcaactatatataga

SEQ ID NO: 84479 - DNA, 201 bp, Homo sapiens
atgggtgtggtggcacatgcctgtggtgtcagctatttgggaagctgaggcaggagcatcacttgaacctgggaggcagcagttgcagtgagccgagatcycgccaccgcacttcagcctgggcgacagagccagacttctactctcaaaaaagaaaaaaaagaaaagaaaggaaaatatgattaactatagagtttattc

SEQ ID NO: 84480 - DNA, 201 bp, Homo sapiens
ttcggccgggagcagtggctcatgcctgtaatcctagcactttgggaggctgaggtgggcggattgcctgacctcaggagttcaagaccagcctgggcaayacggtgaaaccccatctctactaaaatacaaaaaattagctgggcgtggcggtgggcacctgtggtcccagctactcgggaggctgaagcaagagaatca

SEQ ID NO: 84481 - DNA, 201 bp, Homo sapiens; identical to SEQ ID NO: 48205

SEQ ID NO: 84482 - DNA, 201 bp, Homo sapiens
agggttttaacatgttgcacaagctggtcttgaactcctaagctcaagcgatctgcctgccttggcctcccaaagtgctgggattacaggcatgagccacygcacctggccttcaggtttgattttttgccaagacttcctaggcaacattgggtccctccctacggaggctgacatggctggctatctccctttgtaatg

SEQ ID NO: 84483 - DNA, 201 bp, Homo sapiens
ggcaacattgggtccctccctacggaggctgacatggctggctatctccctttgtaatgtcaggagctgttggcactcaagacctcaatttgtggccgggygcagtggttcatgcctgtaatcccagcactttgggaggccgaggcgggtggatcacgaggtcaggagttcgagaccagcctgaccaacatggtgaaaccc

SEQ ID NO: 84484 - DNA, 201 bp, Homo sapiens; identical to SEQ ID NO: 48207

SEQ ID NO: 84485 - DNA, 201 bp, Homo sapiens
cctgggcaacagagcgagactctgtctcaaaaaagacctcaatttgttcattgacagcgttgctgggctgatggcgctaagatctggtggtgaaggagccygggagcagggctgattttctggcagggaaacagccggtaacaaagcccagagacaggaccaaaatattttaagcaagggaggaataaggtcagatgatca

SEQ ID NO: 84486 - DNA, 201 bp, Homo sapiens; identical to SEQ ID NO: 48211

SEQ ID NO: 84487 - DNA, 201 bp, Homo sapiens
tggcgctaagatctggtggtgaaggagcctgggagcagggctgattttctggcagggaaacagccggtaacaaagcccagagacaggaccaaaatattttragcaagggaggaataaggtcagatgatcactctaaatttacaacattctaactctccatttcaactttctaggaatccaacatttcagctttcttagatt

SEQ ID NO: 84488 - DNA, 201 bp, Homo sapiens; identical to SEQ ID NO: 48213

SEQ ID NO: 84489 - DNA, 201 bp, Homo sapiens
ggcacatggcaaaatccatagcctgcaagctggcagcggccaaagctgtcctgggaccacacctggaaatggagccggggccagcctgcaggaaaggagasagaggggaaaggagggatgggtggggaccagactcctgctgattccccactccctgatactcactggagaccccaggcccagtcttttcctctctgggtt

SEQ ID NO: 84490 - DNA, 201 bp, Homo sapiens; identical to SEQ ID NO: 48217

SEQ ID NO: 84491 - DNA, 201 bp, Homo sapiens; identical to SEQ ID NO: 72612

SEQ ID NO: 84492 - DNA, 201 bp, Homo sapiens; identical to SEQ ID NO: 72613

SEQ ID NO: 84493 - DNA, 201 bp, Homo sapiens
tgaatgggccagaggcagagtgatgaataatggaaaaatagggaccgggggcaagggaggtaacggacaggagttcatggatccaaaacatgatggctaartagagaagggccggaagaacgacgaaagtgagcaggcaggctggagctaaaagtagtctgggcaatgaagctcaaatgaatggggcagaggcatgatggg

SEQ ID NO: 84494 - DNA, 201 bp, Homo sapiens; identical to SEQ ID NO: 48220

SEQ ID NO: 84495 - DNA, 201 bp, Homo sapiens; identical to SEQ ID NO: 48221

SEQ ID NO: 84496 - DNA, 201 bp, Homo sapiens; identical to SEQ ID NO: 48222

SEQ ID NO: 84497 - DNA, 201 bp, Homo sapiens; identical to SEQ ID NO: 48224

SEQ ID NO: 84498 - DNA, 201 bp, Homo sapiens; identical to SEQ ID NO: 48225

SEQ ID NO: 84499 - DNA, 201 bp, Homo sapiens; identical to SEQ ID NO: 75724

SEQ ID NO: 84500 - DNA, 201 bp, Homo sapiens; identical to SEQ ID NO: 75725

SEQ ID NO: 84501 - DNA, 201 bp, Homo sapiens
ccgcagcttggacaggatctggccgcggatggcctcgatgcgcttccgcttcaccagctccatgtcgatagtcttgcaggtggatagtcccgcggccggcsggccaggcgtcagcaccagtagccacagcagcggtagcagcagcagcagcagccgcagcccggagggcggcatgggggaggcggcgccccccggcactgc

SEQ ID NO: 84502 - DNA, 201 bp, Homo sapiens; identical to SEQ ID NO: 75727

SEQ ID NO: 84503 - DNA, 201 bp, Homo sapiens; identical to SEQ ID NO: 8953

SEQ ID NO: 84504 - DNA, 201 bp, Homo sapiens; identical to SEQ ID NO: 75729

SEQ ID NO: 84505 - DNA, 201 bp, Homo sapiens; identical to SEQ ID NO: 75730

SEQ ID NO: 84506 - DNA, 201 bp, Homo sapiens; identical to SEQ ID NO: 75731

SEQ ID NO: 84507 - DNA, 201 bp, Homo sapiens; identical to SEQ ID NO: 75732

SEQ ID NO: 84508 - DNA, 201 bp, Homo sapiens; identical to SEQ ID NO: 75733

SEQ ID NO: 84509 - DNA, 201 bp, Homo sapiens; identical to SEQ ID NO: 75736

SEQ ID NO: 84510 - DNA, 201 bp, Homo sapiens; identical to SEQ ID NO: 72629

SEQ ID NO: 84511 - DNA, 201 bp, Homo sapiens; identical to SEQ ID NO: 75737

SEQ ID NO: 84512 - DNA, 201 bp, Homo sapiens; identical to SEQ ID NO: 72636

SEQ ID NO: 84513 - DNA, 201 bp, Homo sapiens
aaaatttcactttgttgccctggctggtcttgaacttttgggtttaagtaatcctcccaccttggcctcccaaagtgctgggattacaggcttgagccacygtacccagctggaatctcatgtttaatattccagacctgtcacaaacactaagaggtgtagcctcttagactgtacaaggctaacggcagccagagagct

SEQ ID NO: 84514 - DNA, 201 bp, Homo sapiens
aggcctccatccaggctacaaggctcacctgaagcaatagttggtgtccagggctcggcggtgccgggagctttgcagatgctgggccctctccagcgggrtggccatgagaagcaggaaaggccggttcatgccatgaatggtggccaggtcacctcggcggccggtagtgaaccctgctttggtgtgggagtcagggga

SEQ ID NO: 84515 - DNA, 201 bp, Homo sapiens; identical to SEQ ID NO: 8952

SEQ ID NO: 84516 - DNA, 201 bp, Homo sapiens
actttccgagaaaccgctggcccccatgatctgcccgatcacgtgcacctcagccatggccctgggaggggaaaaatataatcacaaccctgtgaggtaastgtattatctccatttgacagggggggaaactgaggcccagcaagtaaagggtagtactaggattccaagctagcttcgtcacacccctgaggctgaggt

SEQ ID NO: 84517 - DNA, 201 bp, Homo sapiens; identical to SEQ ID NO: 75743

SEQ ID NO: 84518 - DNA, 201 bp, Homo sapiens; identical to SEQ ID NO: 48248

SEQ ID NO: 84519 - DNA, 201 bp, Homo sapiens; identical to SEQ ID NO: 48250

SEQ ID NO: 84520 - DNA, 201 bp, Homo sapiens; identical to SEQ ID NO: 75745

SEQ ID NO: 84521 - DNA, 201 bp, Homo sapiens; identical to SEQ ID NO: 48252

SEQ ID NO: 84522 - DNA, 201 bp, Homo sapiens; identical to SEQ ID NO: 75746

SEQ ID NO: 84523 - DNA, 201 bp, Homo sapiens; identical to SEQ ID NO: 75747

SEQ ID NO: 84524 - DNA, 201 bp, Homo sapiens; identical to SEQ ID NO: 75748

SEQ ID NO: 84525 - DNA, 201 bp, Homo sapiens; identical to SEQ ID NO: 75749

SEQ ID NO: 84526 - DNA, 201 bp, Homo sapiens
cccaccttcccacctcctgctccaccctggcctctgccctaatcatacaaacttgggatcgcctattgagcaggcctgggaaggccttagctcagcctctycagggccagacttggctgcaaaagggacctacgtggtatggggagcagggacaggtcttggtgttcccagccccagggacctcagaggctactggccccc

SEQ ID NO: 84527 - DNA, 201 bp, Homo sapiens; identical to SEQ ID NO: 75750

SEQ ID NO: 84528 - DNA, 201 bp, Homo sapiens; identical to SEQ ID NO: 75751

SEQ ID NO: 84529 - DNA, 201 bp, Homo sapiens; identical to SEQ ID NO: 75752

SEQ ID NO: 84530 - DNA, 201 bp, Homo sapiens; identical to SEQ ID NO: 75754

SEQ ID NO: 84531 - DNA, 201 bp, Homo sapiens
ctgaatggcgcttcgggattctgagtagcaggggcagcatgcccagtgggcctggggtcccgggagggattccagaattgaggggcacgcaggattctgamcaccaggggcagaggcggccagacaacctcagggaggagtgtcctggcgtccccatcctccaaagggcctgggcccgccccgagggggcagcgagaggag

SEQ ID NO: 84532 - DNA, 201 bp, Homo sapiens
agtccaaaataaccttttcgggttcaggtcggcggaaagccccgcccgaaggggctatggctccgcccacgagcgcaaaagacccgccttccgcgtcacgycagccaccccgcttccctcccccagcaagctccataaggcgcatgcgttatgagttcaggtccgacttaaccccgcctctaagcgcagcgcatgcgtcat

SEQ ID NO: 84533 - DNA, 201 bp, Homo sapiens; identical to SEQ ID NO: 48169

SEQ ID NO: 84534 - DNA, 201 bp, Homo sapiens; identical to SEQ ID NO: 8947

SEQ ID NO: 84535 - DNA, 201 bp, Homo sapiens; identical to SEQ ID NO: 48172

SEQ ID NO: 84536 - DNA, 201 bp, Homo sapiens; identical to SEQ ID NO: 8948

SEQ ID NO: 84537 - DNA, 201 bp, Homo sapiens; identical to SEQ ID NO: 48173

SEQ ID NO: 84538 - DNA, 201 bp, Homo sapiens; identical to SEQ ID NO: 48174

SEQ ID NO: 84539 - DNA, 201 bp, Homo sapiens; identical to SEQ ID NO: 48176

SEQ ID NO: 84540 - DNA, 201 bp, Homo sapiens; identical to SEQ ID NO: 48183

SEQ ID NO: 84541 - DNA, 201 bp, Homo sapiens
aaggagagtcaggctgggaaacaaggtaggagaagagggtctgtcaacatgggggcctccggagggtgtcagtgggaggagggggcaacaggacacctgarggatggaagggtcaggaggcagacacctgtaagaattgctctcctttactgagcacctcccatgtggctaagcagcctcctgtcactcaacaccctgcga

SEQ ID NO: 84542 - DNA, 201 bp, Homo sapiens
ccttagctggggtcagctctgacagtctctagagtctgtgctcttgaccactgtgccatcctcccccatcactgggtgtccggggtgtggatggtggtgaygttggaggcagagtccctcagcactccacgccgtagcggtcgaagttgcggagcagcaggccgatctccaggtgcacggtgccaccagcagctgtgtgca

SEQ ID NO: 84543 - DNA, 201 bp, Homo sapiens
gtgcacggtgccaccagcagctgtgtgcaggcgatagcggtcggccccactgtagatggtgtccccatgcagcagctgcggcccaccacccacgaaagccygtgccaactgttctcgccaactgcccaggggccgccacgtggggcaggccagctggtgggtgcccgggctactgggcacatggcaaaatccatagcctgc

SEQ ID NO: 84544 - DNA, 201 bp, Homo sapiens
tcaccctctccagcccatgccctgaccttccttctggctcatgtcctcacctggtacagctccacgtgctgctccacttttaacttgagcctcagcagacrcagctctgcccgggagagcaacacgggttcaggtaccgcttctcggagctctgatgtgttgaagaacatatatatgctgtgtgtactctgcttgaacttg

SEQ ID NO: 84545 - DNA, 201 bp, Homo sapiens; identical to SEQ ID NO: 75691

SEQ ID NO: 84546 - DNA, 201 bp, Homo sapiens; identical to SEQ ID NO: 48190

SEQ ID NO: 84547 - DNA, 201 bp, Homo sapiens; identical to SEQ ID NO: 48191

SEQ ID NO: 84548 - DNA, 201 bp, Homo sapiens
ccgcttcaccagctccatgtcgatagtcttgcaggtggatagtcccgcggccggccggccaggcgtcagcaccagtagccacagcagcggtagcagcagcrgcagcagccgcagcccggagggcggcatgggggaggcggcgccccccggcactgccgagagcgcgaacagggctggtgtggtggggaggccccgcccctg

SEQ ID NO: 84549 - DNA, 201 bp, Homo sapiens
cgcctctcctttcccaaatgctggggtcttcgcttctcccacaccaggctcccttctctgcacctggcaccccacgaccccccccccattcaacgcgtcckggaagagggagccttctaccctccccctattgcttgtctccctctaggggactgcccccacgaccccgcatgtttctgtcgcactctagaagcggtccac

SEQ ID NO: 84550 - DNA, 201 bp, Homo sapiens; identical to SEQ ID NO: 8946

SEQ ID NO: 84551 - DNA, 201 bp, Homo sapiens
gtggcatcttgttggcatggggagagagcggtcaggattttggggtcaagagcagattggtaatctgtgtcgtgcgtaggaagtgatcttgagttcctgtrctctctctacctccaggaaatgcctcgataccatgagctgcccaccttggaagaacggtcaggacccttgcaccctggagccacaagcctggggtccccc

SEQ ID NO: 84552 - DNA, 201 bp, Homo sapiens
tcttggcattcctgaattccagtatgccagtattgcatcccaacattccaaagttctgagccatcactcaagaggttcaaactgacactttctttctttttttttttttttttttttagatggagtctcgcatcattgcccaggccggagtgcagtggcgcgatctcggttcactgcaacctccacccccgaggttccagt

SEQ ID NO: 84553 - DNA, 201 bp, Homo sapiens
attgaaggcacctgccgccacgcccagctaattagtagagatggggttttgccatgtatggccgcgcctggccatcccggctactttggaggctgaagccrgaggatgccttgagtgcaggaagtccaggctgcagtgagctatgatggcaccctgcactccagcctgggcaacaaagtaagactgcacctctaaaaaaaa

SEQ ID NO: 84554 - DNA, 201 bp, Homo sapiens
taaaagcataaatgagagggaggtgagggagagagataggggcaccatgggccctgccagaaaccagacagagacaatcatctcctggacagatcaaatgdgttaggctctccctggcctccaggcctttgcacaggctgttccctttgcctggaatcttttttttttttttttttttttgagatgggatctcactctttc

SEQ ID NO: 84555 - DNA, 201 bp, Homo sapiens
agaaaccagacagagacaatcatctcctggacagatcaaatgagttaggctctccctggcctccaggcctttgcacaggctgttccctttgcctggaatcttttttttttttttttttttttgagatgggatctcactctttcatgtaggctggattgcagtagtgtgattatggctcactgcagcctcgacctcccaggc

SEQ ID NO: 84556 - DNA, 201 bp, Homo sapiens
ttgagcccaggagtttgaggctgcagtgagctgtgatcatgccaaggtacttcagcctgggtgacagagtgaaaacctgtcaccttttttttggggggggkggttattgggtttttttgagacagagtctcgttctgtgggccagggctcacagcaacttctgcctcccaggctcaagcaattctcctgcctcagcctccc

SEQ ID NO: 84557 - DNA, 201 bp, Homo sapiens
gaaaccagacagagacaatcatctcctggacagatcaaatgagttaggctctccctggcctccaggcctttgcacaggctgttccctttgcctggaatcttttttttttttttttttttttgagatgggatctcactctttcatgtaggctggattgcagtagtgtgattatggctcactgcagcctcgacctcccaggct

SEQ ID NO: 84558 - DNA, 201 bp, Homo sapiens
ggctaggggtcttggtgtggaaatgaaccaggcttgggggaatacctgtgtgaatgccccacttgcagaagaggctactttccgagaaaccgctggccccyatgatctgcccgatcacgtgcacctcagccatggccctgggaggggaaaaatataatcacaaccctgtgaggtaactgtattatctccatttgacagggg

SEQ ID NO: 84559 - DNA, 201 bp, Homo sapiens
gcaggagaatcgcttgaacccaggaagcaaaggttgtggtgagccaagatggtgccattgcactccagcctgggcaacaggagcaaaactccatcacacamacacacaaaaaaaagaagaattttctggggctggatagtccactccagggactgcagaataaagctgaattccccagactccaagaagccaagctaacat

SEQ ID NO: 84560 - DNA, 201 bp, Homo sapiens; identical to SEQ ID NO: 84551

SEQ ID NO: 84561 - DNA, 201 bp, Homo sapiens
agacagatagggaggaagacagagaggagggagaggaagggttggagggtgatgcagagagggagaggcggggagatgtcagagacggagacgaggcaacmggaccgtggaggagaaaaatagaaagggagagaaaatagtcggagagacaaaaaccaggagacccatgcgtggacagaaagactaacggagacgaaaaga

SEQ ID NO: 84562 - DNA, 201 bp, Homo sapiens
ccctggcctcccaaagtgctgggattgcaggcatgagccaccacgcctggcctatatatatatatttttgagacggtctcgctccatcacccaggctggartgcagtggtgcaatcacagttcactacagcctcgacctcctgggctcaatcaatcctcccacctcagactactgagtagctgggactagaggcacgcatc

SEQ ID NO: 84563 - DNA, 201 bp, Homo sapiens
tgaggtcataccactgcactccagcttggcaacagagtgagacactgtctcaaaaaaaaaaaaaagagttctaggattgtatggtttgtgttcttctatcyttcagggaccatctaggtggaccttgtaaccagccgacccacagccacccccttggtcacagctcaccctctccagcccatgccctgaccttccttctgg

SEQ ID NO: 84564 - DNA, 201 bp, Homo sapiens
catgtcagggcagcccattgctcctccagtccccaggtaaccatcatgggccttgtcagggacacctcctgccttccctcctcatgtccctgccctgctcyctttgggcccagggccttctttcttgcccctctctaatccaccttccacctggcatctggaagcatctttctctccttccatagctttgcccatgtcctc

SEQ ID NO: 84565 - DNA, 201 bp, Homo sapiens
ggctgatttcgaactcctgacctcaggtgatctgcccgccttggcctcccaaagtactgggattacaggtgtgaaccaccatgcctggcccactatcctctccttccttccttccttccttccttccttccttccttccttccttccttccttccttccttccttctttccttccttccttctttccttcctccctccctc

SEQ ID NO: 84566 - DNA, 201 bp, Homo sapiens
gctgatttcgaactcctgacctcaggtgatctgcccgccttggcctcccaaagtactgggattacaggtgtgaaccaccatgcctggcccactatcctctccttccttccttccttccttccttccttccttccttccttccttccttccttccttccttccttctttccttccttccttctttccttcctccctccctcc

SEQ ID NO: 84567 - DNA, 201 bp, Homo sapiens
gcagctgtgtgcaggcgatagcggtcggccccactgtagatggtgtccccatgcagcagctgcggcccaccacccacgaaagcccgtgccaactgttctckccaactgcccaggggccgccacgtggggcaggccagctggtgggtgcccgggctactgggcacatggcaaaatccatagcctgcaagctggcagcggcca

SEQ ID NO: 84568 - DNA, 201 bp, Homo sapiens
ctccctcccaaactgccgggattacaggcgtgagccacccagccaggccaatagatacaaagtatttacaagctaccattggctaggcgcggtggctcatractgtaatcccagccctttggaaggctgaggcgggaagagctcttgaggccagaagttcgaatatagggagaccccattaataatgcatatatcaactag

SEQ ID NO: 84569 - DNA, 201 bp, Homo sapiens
agccctttggaaggctgaggcgggaagagctcttgaggccagaagttcgaatatagggagaccccattaataatgcatatatcaactagtgaagtattccrttgaattgtttaatataaatgttatcctattgaaatgttgtaccctcgttataattttggttttttactttttgagatggcgtctccccctgtcatccag

SEQ ID NO: 84570 - DNA, 201 bp, Homo sapiens
tcccgcggccggccggccaggcgtcagcaccagtagccacagcagcggtagcagcagcagcagcagccgcagcccggagggcggcatgggggaggcggcgycccccggcactgccgagagcgcgaacagggctggtgtggtggggaggccccgcccctgcaggggctgggggtctcccggcaaaaggtaggagggcctcga

SEQ ID NO: 84571 - DNA, 201 bp, Homo sapiens
cccaccttcccacctcctgctccaccctggcctctgccctaatcatacaaacttgggatcgcctattgagcaggcctgggaaggccttagctcagcctctrcagggccagacttggctgcaaaagggacctacgtggtatggggagcagggacaggtcttggtgttcccagccccagggacctcagaggctactggccccc

SEQ ID NO: 84572 - DNA, 201 bp, Homo sapiens
accgcttctcggagctctgatgtgttgaagaacatatatatgctgtgtgtactctgcttgaacttgtcatagatttctagcagggagaaatgaagggaggmgatcaggggtttggcagaggtgaggggagctggtgctcccaactctaggagttttggagctgacagctctggggtggagtcagtctctgataccttttat

SEQ ID NO: 84573 - DNA, 201 bp, Homo sapiens; identical to SEQ ID NO: 84571

SEQ ID NO: 84574 - DNA, 201 bp, Homo sapiens; identical to SEQ ID NO: 48206

SEQ ID NO: 84575 - DNA, 201 bp, Homo sapiens; identical to SEQ ID NO: 48208

SEQ ID NO: 84576 - DNA, 201 bp, Homo sapiens; identical to SEQ ID NO: 84385

SEQ ID NO: 84577 - DNA, 201 bp, Homo sapiens; identical to SEQ ID NO: 48210

SEQ ID NO: 84578 - DNA, 201 bp, Homo sapiens; identical to SEQ ID NO: 48212

SEQ ID NO: 84579 - DNA, 201 bp, Homo sapiens; identical to SEQ ID NO: 75715

SEQ ID NO: 84580 - DNA, 201 bp, Homo sapiens
gtggcatcttgttggcatggggagagagcggtcaggattttggggtcaagagcagattggtaatctgtgtcgtgcgtaggaagtgatcttgagttcctgtmctctctctacctccaggaaatgcctcgataccatgagctgcccaccttggaagaacggtcaggacccttgcaccctggagccacaagcctggggtccccc

SEQ ID NO: 84581 - DNA, 201 bp, Homo sapiens; identical to SEQ ID NO: 75717

SEQ ID NO: 84582 - DNA, 201 bp, Homo sapiens
ctgatttcgaactcctgacctcaggtgatctgcccgccttggcctcccaaagtactgggattacaggtgtgaaccaccatgcctggcccactatcctctccttccttccttccttccttccttccttccttccttccttccttccttccttccttccttccttctttccttccttccttctttccttcctccctccctccc

SEQ ID NO: 84583 - DNA, 201 bp, Homo sapiens; identical to SEQ ID NO: 75718

SEQ ID NO: 84584 - DNA, 201 bp, Homo sapiens; identical to SEQ ID NO: 75719

SEQ ID NO: 84585 - DNA, 201 bp, Homo sapiens; identical to SEQ ID NO: 75721

SEQ ID NO: 84586 - DNA, 201 bp, Homo sapiens
gaagcaggaaaggccggttcatgccatgaatggtggccaggtcacctcggcggccggtagtgaaccctgctttggtgtgggagtcaggggataggggacakacacacacactctcagagggatagataagtggggcgtggggcagatgggaacacacacacgcacacacgtcacaactgggcatggccggggaagcaggcc

SEQ ID NO: 84587 - DNA, 201 bp, Homo sapiens
gcagcagccaggtgtccaacctggagcacctggtcagcagatggcagtcatgcccccagcctggaaggcctccatccaggctacaaggctcacctgaagcyatagttggtgtccagggctcggcggtgccgggagctttgcagatgctgggccctctccagcggggtggccatgagaagcaggaaaggccggttcatgcca

SEQ ID NO: 84588 - DNA, 201 bp, Homo sapiens
cagacctcatcccctgagccctccaagctaaaggagacagatgctcagcccaagcacagcagcagccaggtgtccaacctggagcacctggtcagcagatrgcagtcatgcccccagcctggaaggcctccatccaggctacaaggctcacctgaagcaatagttggtgtccagggctcggcggtgccgggagctttgcag

SEQ ID NO: 84589 - DNA, 201 bp, Homo sapiens
ggggccggtgccagcgccagcatctggactcttggcaaggagccctggagccctggagcgagggaactccggccccacaaaggccagggaatcctccagtytggtgagacggagggcttctgggaagggaggcctatacaaggctccatgaaggaggtggaagcttgcaagacgatgatagtcttgtaatcagtccgatgg

SEQ ID NO: 84590 - DNA, 201 bp, Homo sapiens; identical to SEQ ID NO: 48232

SEQ ID NO: 84591 - DNA, 201 bp, Homo sapiens
gtggcaccgtgtcagctcactgcaacctccgccttccgggtttaaccgattctcctgcttcagcctcctgagcagctgggactacaggcgtgtgccacctygtccagctaatttttgtatttttagtagagacggggtttcaccatattggccacgctggtctcgaactcctgaccttgtgatccacccgcctcggcctcc

SEQ ID NO: 84592 - DNA, 201 bp, Homo sapiens; identical to SEQ ID NO: 8957

SEQ ID NO: 84593 - DNA, 201 bp, Homo sapiens
ttacaggcatgagccactgtacctggccagcactttattttattgttattattattattactttgttttttcataacattgatgttttgaaggttataggygacctcctttgtagagtgtccctcattttggctttgtctcatgtttcttattattagatttaagttatgcattttggcaggaaaaccaaagaaatggtat

SEQ ID NO: 84594 - DNA, 201 bp, Homo sapiens; identical to SEQ ID NO: 48241

SEQ ID NO: 84595 - DNA, 201 bp, Homo sapiens; identical to SEQ ID NO: 48242

SEQ ID NO: 84596 - DNA, 201 bp, Homo sapiens; identical to SEQ ID NO: 48243

SEQ ID NO: 84597 - DNA, 201 bp, Homo sapiens; identical to SEQ ID NO: 48244

SEQ ID NO: 84598 - DNA, 201 bp, Homo sapiens; identical to SEQ ID NO: 48245

SEQ ID NO: 84599 - DNA, 201 bp, Homo sapiens; identical to SEQ ID NO: 48247

SEQ ID NO: 84600 - DNA, 201 bp, Homo sapiens; identical to SEQ ID NO: 48249

SEQ ID NO: 84601 - DNA, 201 bp, Homo sapiens; identical to SEQ ID NO: 48253

SEQ ID NO: 84602 - DNA, 201 bp, Homo sapiens
aatttacagatagggaaactgggcccagagggaccccgaggtcctagaaaggacagaagcggtgccatgccttagctggggtcagctctgacagtctctaragtctgtgctcttgaccactgtgccatcctcccccatcactgggtgtccggggtgtggatggtggtgacgttggaggcagagtccctcagcactccacgc

SEQ ID NO: 84603 - DNA, 201 bp, Homo sapiens; identical to SEQ ID NO: 48254

SEQ ID NO: 84604 - DNA, 201 bp, Homo sapiens; identical to SEQ ID NO: 48256

SEQ ID NO: 84605 - DNA, 201 bp, Homo sapiens
gagggcttcctggaggtggagtctagcctggcactcagggtgggtggaaactgatcgtcattttgcccacaggaatcctcgtagcccactacctccagagratcacgccttgcctggccctgggtggagagctggtctaccaccggcggcctggagaggagggcactgtcatgtctctagctgggaaatacacatgtgagc

SEQ ID NO: 84606 - DNA, 201 bp, Homo sapiens; identical to SEQ ID NO: 72553

SEQ ID NO: 84607 - DNA, 201 bp, Homo sapiens
ctaatttttgtatttttagtagagacgggttttcaccatattggccagaccggtctcaaactcctgacctcaggtggtccacccgcctcagcctcccaaartgctgggattacaggcgttagccaccgtgaccggccgggttttttttttttttttttttttgacagagtctccctctgtcgcccaggctggagtgcagtg

SEQ ID NO: 84608 - DNA, 201 bp, Homo sapiens; identical to SEQ ID NO: 72555

SEQ ID NO: 84609 - DNA, 201 bp, Homo sapiens; identical to SEQ ID NO: 72559

SEQ ID NO: 84610 - DNA, 201 bp, Homo sapiens; identical to SEQ ID NO: 72562

SEQ ID NO: 84611 - DNA, 201 bp, Homo sapiens; identical to SEQ ID NO: 75688

SEQ ID NO: 84612 - DNA, 201 bp, Homo sapiens; identical to SEQ ID NO: 8949

SEQ ID NO: 84613 - DNA, 201 bp, Homo sapiens; identical to SEQ ID NO: 72565

SEQ ID NO: 84614 - DNA, 201 bp, Homo sapiens; identical to SEQ ID NO: 48179

SEQ ID NO: 84615 - DNA, 201 bp, Homo sapiens; identical to SEQ ID NO: 72567

SEQ ID NO: 84616 - DNA, 201 bp, Homo sapiens; identical to SEQ ID NO: 48180

SEQ ID NO: 84617 - DNA, 201 bp, Homo sapiens; identical to SEQ ID NO: 72570

SEQ ID NO: 84618 - DNA, 201 bp, Homo sapiens; identical to SEQ ID NO: 8951

SEQ ID NO: 84619 - DNA, 201 bp, Homo sapiens; identical to SEQ ID NO: 72575

SEQ ID NO: 84620 - DNA, 201 bp, Homo sapiens; identical to SEQ ID NO: 72577

SEQ ID NO: 84621 - DNA, 201 bp, Homo sapiens; identical to SEQ ID NO: 72580

SEQ ID NO: 84622 - DNA, 201 bp, Homo sapiens; identical to SEQ ID NO: 48196

SEQ ID NO: 84623 - DNA, 201 bp, Homo sapiens; identical to SEQ ID NO: 48197

SEQ ID NO: 84624 - DNA, 201 bp, Homo sapiens
ggcggaggttgcagtgagccgagatcacgccactgcactccagcctgggcaacagagcgagactctgtctcaaaaaagacctcaatttgttcattgacagsgttgctgggctgatggcgctaagatctggtggtgaaggagcctgggagcagggctgattttctggcagggaaacagccggtaacaaagcccagagacagg

SEQ ID NO: 84625 - DNA, 201 bp, Homo sapiens; identical to SEQ ID NO: 75696

SEQ ID NO: 84626 - DNA, 201 bp, Homo sapiens; identical to SEQ ID NO: 48199

SEQ ID NO: 84627 - DNA, 201 bp, Homo sapiens; identical to SEQ ID NO: 48200

SEQ ID NO: 84628 - DNA, 201 bp, Homo sapiens; identical to SEQ ID NO: 75698

SEQ ID NO: 84629 - DNA, 201 bp, Homo sapiens; identical to SEQ ID NO: 75699

SEQ ID NO: 84630 - DNA, 201 bp, Homo sapiens; identical to SEQ ID NO: 75700

SEQ ID NO: 84631 - DNA, 201 bp, Homo sapiens; identical to SEQ ID NO: 75701

SEQ ID NO: 84632 - DNA, 201 bp, Homo sapiens; identical to SEQ ID NO: 75702

SEQ ID NO: 84633 - DNA, 201 bp, Homo sapiens; identical to SEQ ID NO: 75703

SEQ ID NO: 84634 - DNA, 201 bp, Homo sapiens; identical to SEQ ID NO: 72597

SEQ ID NO: 84635 - DNA, 201 bp, Homo sapiens; identical to SEQ ID NO: 72598

SEQ ID NO: 84636 - DNA, 201 bp, Homo sapiens; identical to SEQ ID NO: 75704

SEQ ID NO: 84637 - DNA, 201 bp, Homo sapiens; identical to SEQ ID NO: 48202

SEQ ID NO: 84638 - DNA, 201 bp, Homo sapiens; identical to SEQ ID NO: 72599

SEQ ID NO: 84639 - DNA, 201 bp, Homo sapiens; identical to SEQ ID NO: 48203

SEQ ID NO: 84640 - DNA, 201 bp, Homo sapiens
acggcagacatgaacatggatggcagacaaaaattcctgcccccgtgaagctgatatcctagacaacgaatgtagtaaataagcaaattatagggtagatyagatggtggtaattgctgtgagggaaaacagagctgggtagggtgagggtggggataccgctttagcaagaaggggatcaaggaagcttcattaagaagg

SEQ ID NO: 84641 - DNA, 201 bp, Homo sapiens
taataataaataaaataaaattctgctgcaaacattctggggtttactgagcatacggttctgcaaatttgacaccctgaattctcagtaacttagaagtmatttctaatgattccggctgggcacggtggctcacgcctgttatcccagcactttgggaggccaaggcgggtggatctcctgaggtcaggagttcaagac

SEQ ID NO: 84642 - DNA, 201 bp, Homo sapiens
acacgtcacaactgggcatggccggggaagcaggcctcaccgttgatgtccacttgcagtgtgttatccctgctgtcacaggagcagtgggcgctaaggcraaagccctcaatttcccctgtaggagtggcgagagggaagccagtctgagagtgcagctcacccagcccctggaggaagaggaaggaaggagcaaacccc

SEQ ID NO: 84643 - DNA, 201 bp, Homo sapiens; identical to SEQ ID NO: 75716

SEQ ID NO: 84644 - DNA, 201 bp, Homo sapiens; identical to SEQ ID NO: 48219

SEQ ID NO: 84645 - DNA, 201 bp, Homo sapiens; identical to SEQ ID NO: 84404

SEQ ID NO: 84646 - DNA, 201 bp, Homo sapiens
cacacgtcacaactgggcatggccggggaagcaggcctcaccgttgatgtccacttgcagtgtgttatccctgctgtcacaggagcagtgggcgctaaggygaaagccctcaatttcccctgtaggagtggcgagagggaagccagtctgagagtgcagctcacccagcccctggaggaagaggaaggaaggagcaaaccc

SEQ ID NO: 84647 - DNA, 201 bp, Homo sapiens
cattccaaagttctgagccatcactcaagaggttcaaactgacactttctttctttttttttttttttttttttagatggagtctcgcatcattgcccagsccggagtgcagtggcgcgatctcggttcactgcaacctccacccccgaggttccagtgattctcctgccccagcctgggtacctggatagccgtaatccc

SEQ ID NO: 84648 - DNA, 201 bp, Homo sapiens
acactttctttctttttttttttttttttttttagatggagtctcgcatcattgcccaggccggagtgcagtggcgcgatctcggttcactgcaacctccmcccccgaggttccagtgattctcctgccccagcctgggtacctggatagccgtaatcccagccgagtagctgggattacaggtgccagccaccacacctg

SEQ ID NO: 84649 - DNA, 201 bp, Homo sapiens
ctgggattacaggtgccagccaccacacctggctaatttttgtatttttaatagagatggggtttcaccatgttggccaggctggtcttgaactccagacstcagggatccgcccacctcagcctcccaaagtgctggaattataggcgtgagccaccgcgcccagcctgctgccactttctattaataaaatcccagcat

SEQ ID NO: 84650 - DNA, 201 bp, Homo sapiens
ccgcgcccagcctgctgccactttctattaataaaatcccagcattctaatattctaacattccaacactgagttccaacatgctgagataccaatattckgctttctccaactccaacatttgtggatgtgaatatttcaaaacagaattctaccactgtgagcccaatattcaaggactccaatctgccaacactggta

SEQ ID NO: 84651 - DNA, 201 bp, Homo sapiens
cttcctgcctcccccacccaccccactctgccctctcactgcagctctctctttttttttttttttttttttgagacaaggtctcgcagcctcaatctccmaggcccaagcaatcctcccatctcagcctcccgagtagctgggaccacaggcgcgtgctaccacgcatggctaattttttttttttttgagatggagtct

SEQ ID NO: 84652 - DNA, 201 bp, Homo sapiens
gcatccggcctacacggctactttttaaattctctgtagagacagaggtctcactatgttgcccaggctgggctcaagcaatcctcctgccctggcctccygaagtgctgggattacaggcatgagccactgcacccggccagcatcaatctcttgaatgaatgagtgaatgatgttttctaggctcctacaatgtgccga

SEQ ID NO: 84653 - DNA, 201 bp, Homo sapiens
cactgcacccggccagcatcaatctcttgaatgaatgagtgaatgatgttttctaggctcctacaatgtgccgaagcctgtgctgtgtgcttgggactcakcattgaccaagacagatgagctccttctaggcctttgtcgaacagcccaggacactcctcccagtgcccacctgctccctaatccctattttttcttttt

SEQ ID NO: 84654 - DNA, 201 bp, Homo sapiens
cacgatcttggctcactgaaacctccacctcctgggttcaagcaattctcctgcctcagcctcccgagtagctgggattacaggcatgcatcaccacgccsagctaattatgtatttttagtagagacggggtttctccatgttggtcaggctggtctcgaactcccgatctcaggtgatccacccacctcggcctctcaa

SEQ ID NO: 84655 - DNA, 201 bp, Homo sapiens
acaatcaccctcacccagcaagccctcctagactccccagatgggtccaggtgccttctctgggctcccaacagcacttagggcgttcccccatcctgcakgcctccctgtcccagccttgtcctccctgctggtgcctccccatcccattcttgatcattctaggtcattcctgcctggtggggccttgacaagatctct

SEQ ID NO: 84656 - DNA, 201 bp, Homo sapiens
cttaggtgtccagaagtgactgtgggccccatgagggcagaactgagggctgtcttggttatcactatgtcccccacaccacccagcacatggccaggcayacagcaggaacctgtgggcaattattgaataaaagcataaatgagagggaggtgagggagagagataggggcaccatgggccctgccagaaaccagacag

SEQ ID NO: 84657 - DNA, 201 bp, Homo sapiens
ccaggcactaccctctcagacagccacctgtgtggtcctgtggcacccatcctccccaacagtacccatgagaggaggggtggagaaaaagctcaggctgyggtcaagtcaccttcacacagctcagccgaaggtgttttcttgccttctcgaggcctgtttcctcattggtgaaatgctaagccccactcagcgtggaca

SEQ ID NO: 84658 - DNA, 201 bp, Homo sapiens; identical to SEQ ID NO: 75740

SEQ ID NO: 84659 - DNA, 201 bp, Homo sapiens; identical to SEQ ID NO: 72652

SEQ ID NO: 84660 - DNA, 201 bp, Homo sapiens; identical to SEQ ID NO: 72653

SEQ ID NO: 84661 - DNA, 201 bp, Homo sapiens
ggccaacaaagtgaaacctcgtctctactaaaaatacaaaaattagccaggcgtggtggcacacgcctgtaatcccagctactcaggaggctgaggcaggrgaatcacttgaacccaagacacagaggttgcagtgagccgagattgcaccactgcactctagccagggtgacagagtgagactctgtctcaaaaaaaaaa

SEQ ID NO: 84662 - DNA, 201 bp, Homo sapiens; identical to SEQ ID NO: 75758

SEQ ID NO: 84663 - DNA, 201 bp, Homo sapiens
caggcctttgcacaggctgttccctttgcctggaatcttttttttttttttttttttttgagatgggatctcactctttcatgtaggctggattgcagtastgtgattatggctcactgcagcctcgacctcccaggctcaggtgattctcccacctcagtctcccaagcagctggaactacaggcacgtaacagcatgca

SEQ ID NO: 84664 - DNA, 201 bp, Homo sapiens
acagtacccatgagaggaggggtggagaaaaagctcaggctgcggtcaagtcaccttcacacagctcagccgaaggtgttttcttgccttctcgaggcctrtttcctcattggtgaaatgctaagccccactcagcgtggacagcccacaatgctaaaattctgctgctaacattctgggccgggcgcagtggctcacgcc

SEQ ID NO: 84665 - DNA, 201 bp, Homo sapiens
tgctggaatgtcaggatctctctgggttaagaaaagaagggaatgtcatacacagaaagagctactgagtgacagggagagggtctttagctaggttaggmtttccgtcaaggccaccgtggtccatgcttgttatcctggagggtcaaaggggaaggagcaatgccagcctgtccaagaaacctgctgagtaaaagccat

SEQ ID NO: 84666 - DNA, 201 bp, Homo sapiens
acttctgttcatcaaaaggtcccatgaagaaaataagaaggcaagccacaaactgggaggaaacattcacaatacatttatctgacaaaagacttgtatcytgaatatctaatgaagtcttgcaactcaatgagaagacaaaataccaatagcagaaaaaacatttgaacagacgcttcaaaaaagaaagtgtacagatgg

SEQ ID NO: 84667 - DNA, 201 bp, Homo sapiens
aaaattattttacctgtctaatttcaaaatgctcaagtctggctattgtcgtttttgtttcccaagtagctcaggggatgcccaaacaccagatttaatcyttctttcatcatgtttaaattgaaccagtgtcgggaaggaagggaagaggtaaatcacacttcagggggaaagttatcaagttggctgtcctggaaaaag

SEQ ID NO: 84668 - DNA, 201 bp, Homo sapiens
gggtcatagggctcgcaaatggctaagcctgggctcttcaacagcctgctatattgcttatttcagtggacaagggcatgagatctagaggcaggatgccygcactcaaaactgtggctcttacgttggctctgtaaccctgggcaaactactttccttctctgtgccccagtgacctcaactgtaaagtgggaatcatct

SEQ ID NO: 84669 - DNA, 201 bp, Homo sapiens
aggatgcatgagacagaattttaaacagatcacagggtgttggttgagactctcagacatgtctcaagtcatcacttcctccccagccagtgctccggggwttggtaaacaggcaacgaatgaaagagatggtttccaaatcctctcccacctgcccaccaccccaggttcctgtctgtcattccattagctttcttcttt

SEQ ID NO: 84670 - DNA, 201 bp, Homo sapiens
ctcggttcctggtgactgcccagtgccctccattctatgaagtgaatttgatcagagcacaatgatgcaggataagaatcagaaagggcagtgccaaggtrcaggggctacaaggaaaggtgactcccctcgctatctgaggataagaggcaattgatgatggcccaacactcacagcttctatcttccccacaaagggaa

SEQ ID NO: 84671 - DNA, 201 bp, Homo sapiens
atcataatcggcaaaaaattgagcttgtaaaataaattagttggtgattatttgctttgcagaagtgttcaccatagggtttctttaaatgacggactccyttaagtacatttaaaaaataagatctaagttgccaaaggctatttattcacaaatgttaacagatgtatgaagtgatcctgactgtttcagtgtttgggt

SEQ ID NO: 84672 - DNA, 201 bp, Homo sapiens
atgtcctctcccctgcctgtagccctctacacccttgttgaggctcaaactccagaagaataccaataattatgagacggccagatgccaagatgcagaayttaccctcactccttcaggaatgaccttggtcccaattgcctgtgtaagtccttcttgcaatgttgcaggtccttcatgcatctgttaacatttgaatct

SEQ ID NO: 84673 - DNA, 201 bp, Homo sapiens
ctcatagcaggagaaggggctccagagatgaaagcttaacacacgggccccatgcaagcctctgttggctccatgaacatcccaatggccaaaccaagtcycatggccaagctgttgtgactcaggagggcacaccatggcaaagggtgtagtaagagaggtgtgaagaattggggctatttgcaatctaccacaagcagg

SEQ ID NO: 84674 - DNA, 201 bp, Homo sapiens
actttggtgagatggtgtttaggtgagctgggctgagacttaatatatcaattcaatgaaatgtggaccaaagatatcctttctgccaatttccctaaagygagcagaagcattcatcaatgtttcagagaatttccgtttgcattcaaaattagtgtcagctgtctctaaaattatcttgaccaatcaagccacattttg

SEQ ID NO: 84675 - DNA, 201 bp, Homo sapiens
gagtctttatcaggctgcttatcagcaacagcagacagccaggcacaccttttcccagagtctgtaagctttctgctaattgaggctaacagaccgtcctkcaggggacagggtggacaggtttgctccggggcactccaggagctaagatcagagtcagaaggtccaaagaggtggaccccagcagaacttgagcaagga

SEQ ID NO: 84676 - DNA, 201 bp, Homo sapiens
gtggagcaagctcagggctggatcctgcctttactaaaaacaatatttggtcgattatgaatttttttttgcactcattttggctttctgaaaatagtgcrttacattttacttgttttttcctactttctggtgcctcctgaaagtttgtacatgagggagtgcctcactcaccccagtctattctcagccctgcaagag

SEQ ID NO: 84677 - DNA, 201 bp, Homo sapiens
tggctcacacctgtaatcccaacaatttgggaggatgaggtggaaggatcacttgagcctaggagtttgagaccagcctgggcaacatagcaagactccawccctacaaaaaaaaaatttttttaattagctgggcatggtggtgcacacctgtggtcccagccactcaggaggctgaggtgggaggatcacttgagccta

SEQ ID NO: 84678 - DNA, 201 bp, Homo sapiens
agtgcctcactcaccccagtctattctcagccctgcaagagacccatggaaatcagattcctaaaaatccagaaaagttacatggacctctgctgtctcaygtagttgcttctgactctcggcaaagcaattttgcgctccccaagttgtggggcgaaactgtccaccagcgggccagtcatgtttttggttgcgtctgtc

SEQ ID NO: 84679 - DNA, 201 bp, Homo sapiens
gatgagaaagagagctgatgcctcatcctgtctgtctattcttgggaggtttggtgggtgagccaggattccgaagcccccaaaactatgcggacaaacarttcattcacatgtggctgtctgtactcagccatgctctgcaatttattttccgagtgcaattaatttctattccaaagtgggcaaaagtctgtgtgtatg

SEQ ID NO: 84680 - DNA, 201 bp, Homo sapiens
attttccgagtgcaattaatttctattccaaagtgggcaaaagtctgtgtgtatgtgtgtgtgcatttccaattttgaggaactctgtttcaactgaaacrtgacaaggaaggagaccaggtcactttctcatgcaaaacagagaccatccacttccaatacactggaacgcggggtggtgccgtagacagggtcaccctt

SEQ ID NO: 84681 - DNA, 201 bp, Homo sapiens
agctccccctctgaggtttggaactggaattataaagcagaagcattgtttgcctcccagcttcctttgttttaaattcttgcaggaacaaacatgaccakacacatcagagcctttcatgtgccttcagattgaaggccaagttcctcactgtaatggccctttcatctagcacaaatccaaattctccctcggggtcac

SEQ ID NO: 84682 - DNA, 201 bp, Homo sapiens
ctgtttttgttcctggaccactcacacttcctgctgactctggggcagaaaacgggctttctacctgtgcatccccaacagaaaagtcctcgtaggactgrcctttccaacaaactgcgaaacttagccctaagtctccccaattttaaagaagtatcttgccgtccagtgttctaagaaatatgccactccaactcaaaa

SEQ ID NO: 84683 - DNA, 201 bp, Homo sapiens
cagtgttctaagaaatatgccactccaactcaaaactggtacccaaaagtgtgctaatttctaaggaagagatagaaatggttatgtgaggggaaaaaccycctgaaaccatgatcagtcagaacctcaagctcagggtcccttttaatctggccaacaccctcttctttcacatgcccgtctcaaaagcacatcatgaaa

SEQ ID NO: 84684 - DNA, 201 bp, Homo sapiens
cccacccgtcagttgttgccctgcagaagacagtcctggagtccctgaggctgccagtttttcagagaagctcaaaagatggattattatgggaacctaattttttttttttttaaggcaggcagaccgttcctgtgagtagcaaaacaaacttgtccttgggcagaagctgaccggcaggctgccagtttaggcctcaaa

SEQ ID NO: 84685 - DNA, 201 bp, Homo sapiens
caatgctgggtgaagtcagaagtgaggctactggtgccccatggggtcctcagctgcaaattacaaggcattatatctactctgctggacgtaccaaggamatgagagccacagatgcctcacagagctctcagcataggtgtttaacaaagaggtaaacagatcattcctgttctcctgaactgagaccctaatcacccc

SEQ ID NO: 84686 - DNA, 201 bp, Homo sapiens
agaaggtccaaagaggtggaccccagcagaacttgagcaaggactttctactcaccagccagcatcctccaatcacaggattggatatggcaggaggactrgttttggcccaggaagggcttctgcagggctggaggttgtgttgttatcattgtggccaccatcttcaagacgttgagtgtttactagattgtaggcgct

SEQ ID NO: 84687 - DNA, 201 bp, Homo sapiens
ggcagatccagatttcagcccaggcattcgagcccacagtttgagctcttaacccctacaaagggatctgttcctcctccacgtgacaatttggatgagtrggccccaggccccattcctctctaaaccccaggagtctctaaaccaaagtgtgaagctggatctgcaagaagagatggatttgagcagtcccacctccta

SEQ ID NO: 84688 - DNA, 201 bp, Homo sapiens
tctgaaattccaaggatgctcagaaaccctgggaatgtgctatctgctatacaggaggcttggcccccaggaacagggacgccggccctgcctaacccacrctctccacctgagatctctctgctcccttcctctctcactgaacgggtccctgaaggcagttagctgaggacagaggtgatgctttgtcgatacatcatg

SEQ ID NO: 84689 - DNA, 201 bp, Homo sapiens
aaaagaaaagaaaaaaaaaaaactccaggcccagttggttttactggcaaattcttccaaaaatttaaagaaaaaaataataccaattctataaaatctcytccagaaaacagaagagaatatttcccaacttgtttgataaggccagcattactctaataagaaaccagacaaagacattgtaagaatacagaccaaaaa

SEQ ID NO: 84690 - DNA, 201 bp, Homo sapiens
catgctggcctcagctttgaagaacagtccacaatcacactaatacccaaggtccagccaggacataagctggtctgctcaaccctgactctctccctgcracaggaactgatatttagtgaaactcccaatgcaccagctccacacacaccatctcattgaactctcaggataatcgtttcaagtgggtacagcactgtc

SEQ ID NO: 84691 - DNA, 201 bp, Homo sapiens
attcctactctggtctcaagatacattttttcaaaaaagctcagcagagaaaaaagtctgggaaaagaaatactgcaaaatgctaataatgattgcctttsggtggcaggacgatggatgagtttttttttctctttaacgctttcctgcattttacaatttttctccaagggaaaaatgtcaaaaaggtgagaaatgagg

SEQ ID NO: 84692 - DNA, 201 bp, Homo sapiens
gaagtgaccgctggaaagcagctgaacaaagcaaaggtgatcaaggtcactggatgggagatgaaggatgcatcgacacctcaggccgaagggtccttgargacaggaatcaggtctgattcttctttgtctgaaatcgacacattacctgacaaagtcaaaatcctcaataaccactcactcaacccatttgtctaacca

SEQ ID NO: 84693 - DNA, 201 bp, Homo sapiens
agaattggcgtttggtgggatcctgccacattacataggaaggtcttaaaagatccacagcagatgtctgtttgggccacattgctcccctgagaatctcytcccttcttgtggttcactttccccgctgcgtgctgagccatcactctctgaaagactctgtccctttgtttactgggcttttcatccccagccagaaat

SEQ ID NO: 84694 - DNA, 201 bp, Homo sapiens
tcaggtttgcaccttttcatgtgtgttatccttttgaggccatctgccttctccaagcagaacttgtgtttctcatcaatggaggaggaggaaaaaagagygtagagccctctgattttctattatcttgtagatttgctgtaagactgtttaatgttcctctggggtttgaacttttccatggaaaacagtggctaacat

SEQ ID NO: 84695 - DNA, 201 bp, Homo sapiens
cctgcccagggcttccagggcttggaccctgcagtgctgtcggggccacagtcccctcgccagggccagccacagtctcctcgccagggccagccacagtstcttcacagtccccctcagatctggctgcagtgggggcctgggacacgccgcgcctgccagcatccccagactgggagcaaggcacgaatcctgcagaag

SEQ ID NO: 84696 - DNA, 201 bp, Homo sapiens
cactgcctccctctggactgttacaagagagtgagataaacttctaccttatttcagctactgttatctgggtctctgttattcacagccagaccttttcmtaacaaatataaagtcgtaatgaggaaggaaaatgccaaagtttcaatgtccccattttacggaacaagtcccttttttctttgaaacagaacacctgcc

SEQ ID NO: 84697 - DNA, 201 bp, Homo sapiens
cccatagtccttgcagctagagagtaggcagcccctacatgcaagataaggtcatatctcaaaagcctttcctttagtgctcaactagtttctattccaascttcatctctacttcaaactcaaagcgccatttcccatagaagagttctggggataaaaagaggaaaagagttattcttggaggccttccccataaccca

SEQ ID NO: 84698 - DNA, 201 bp, Homo sapiens
cccacctccaaaatttcaatgggaaactctaaaacttgccgcaggggcagtaaatgcagataacactttctttgagatcaacaactccagggttccattcrgtatgctggataacttcttttttaggaaattaacacaaaggagaaattgatatttccctctgaaattccaaggatgctcagaaaccctgggaatgtgcta

SEQ ID NO: 84699 - DNA, 201 bp, Homo sapiens
ccatgtgcaaaacatcccatccccaccagctcaactcattacagcatcaactctatgtccaaaatctcatctaaatatcatcaggtcaaaagtgccaaatstcttcatctaaatcagtatgggtgagacattttgtacggtccatcctcagacaaaattcctcttcatctgtgcctctgtgaacctagaaagcaagctacc

SEQ ID NO: 84700 - DNA, 201 bp, Homo sapiens
gctacttgggaggctgaagcaggagaattcttgaactcgggaagcggaggttgcagtgagccgagacacaccactgcactccagcctgggagacagagtgwgactctgtctcaagaaaccaaaaaaaaagaaagaaatcagaggaattggtatggggttgggtgtgaagtttttttttcatctggtttgagttatgaaatc

SEQ ID NO: 84701 - DNA, 201 bp, Homo sapiens
gagagacaaaagagttgtcctgtgtgttgagcacatgaacagtgacagttatgcccatttgacaaatgaggaaacagaggtgacacagagataagaaggcrtttgcctgagattggacgtcgaatgagttctaggcaccaagggaagcagggaagggagtgatacccaatgcatgaggtgcagacctgaccccaaggaagt

SEQ ID NO: 84702 - DNA, 201 bp, Homo sapiens
gtattacgacaaaactgaaaacatgggcctctagggagactctaatccagctgagcagatggagaagtagcacacagacattccatgggtatagacccggkatcaggccacaggccaaacctggcctactacctgattttgcaaataaagttttattggcacacagctgcacctttgttacgtgtcatccatggctgcttt

SEQ ID NO: 84703 - DNA, 201 bp, Homo sapiens
ttatgaaatcagggtcatgttgatatttttcatgctgtactcagatgacagtgattattttctttcattcatttattttctttttgtatcagcttcagctmtgaaatcctcctcagtacagccttcctgatcttcctaaaattgcacaggatgagaaggattttctgtttcctaagcaagtcggctccattggggtgggtc

SEQ ID NO: 84704 - DNA, 201 bp, Homo sapiens
ccacaggcccaacccgtgctatagcagaaaaagcaaggggcagaagactgtggcttaagtcccaggaccactcatgtcactgcctcttgatgtggggaccstgggcaagtcacctggcatctgagtctcggttctggaatttgcaaaatgagatgtgacttctggtcctgccttcctcacaaaggggctgtgacagtccag

SEQ ID NO: 84705 - DNA, 201 bp, Homo sapiens
gctgagaacataaaacgccgcacagagctaagagaagaagacagtgtgttcagctggatgatcagaggaggcagcattgtccttggtccctaaagcaagcygggcgccatgatttgaggcagcagcctgcagtgacactcgccaacaccagctctcaagcgaaagagctccctttcctactgttcttctggcttctgacga

SEQ ID NO: 84706 - DNA, 201 bp, Homo sapiens
aaagaaaaatcctgcaccaggaatgagactcatggcctgggggtccctcgccctctcgcctagactcagccccctctgtcccagcatctctgacatcaggrcaaaccttctggtttgcttggagtgcacactcaaccagcccctcttacccacagagaaaccaccaagggctctggtaggctaaaggaaaatcacatgctt

SEQ ID NO: 84707 - DNA, 201 bp, Homo sapiens
ggaaaatcacatgcttctatgcaagccaaggctacatttccagaataaaatttaggacttgtgatggaccaaggatttgggttttgcccatgtgttaacayatgttaataaaaataatcttgcaaaagggtaaatatatgattacatagaattatatatatgaatcatcactatcaaaaagaacaaaaccccagccctaac

SEQ ID NO: 84708 - DNA, 201 bp, Homo sapiens
aaaatcacatgcttctatgcaagccaaggctacatttccagaataaaatttaggacttgtgatggaccaaggatttgggttttgcccatgtgttaacataygttaataaaaataatcttgcaaaagggtaaatatatgattacatagaattatatatatgaatcatcactatcaaaaagaacaaaaccccagccctaacaa

SEQ ID NO: 84709 - DNA, 201 bp, Homo sapiens
gtgcagggaaaaaaccacatcctttcaagatccctggcccatcttcctccctttcttctcctctctttgataatgctgttgcatttctcatagtgggcggsggggagggttccccaagtcctcagatgcctccggcatcacacacagggacttcacgaaaggtcccctttgtcccagtgctcacctctaccagctagattt

SEQ ID NO: 84710 - DNA, 201 bp, Homo sapiens
tgtctgaaatcgacacattacctgacaaagtcaaaatcctcaataaccactcactcaacccatttgtctaaccatgggtttgctgtgtgccctaagcaccktacttgggtgatgtcactgaattctcaatataatcctatatgatcaaggccaacattaccattgacagcctggacctctgataggctaatgagaagcaca

SEQ ID NO: 84711 - DNA, 201 bp, Homo sapiens
gttaataaaaataatcttgcaaaagggtaaatatatgattacatagaattatatatatgaatcatcactatcaaaaagaacaaaaccccagccctaacaaygtaacaagacccgatctctacaaaaaaaaaaaaaaattactaaattagctaggcatggtgacacgcacctgtggttccagctactcgggaggctgaggtg

SEQ ID NO: 84712 - DNA, 201 bp, Homo sapiens
tactattgtttttcccaattgacaggtaaggaaacggtccaggtgagttcagaatcattgtctcctaagctgatgatcattctagtatcttctgggacccygctttaaggctcctgtttacaccagggcccctgagaattagatcatgaaagatttccaagggatagtttctctgctcagaatcatgagtgacccaaatcg

SEQ ID NO: 84713 - DNA, 201 bp, Homo sapiens
actaacaactcctgaattctatactttaaaggagggaatcttatggcatgtgaattctatcttaatataattggctatgaaaaggaaagttgctgtcgggaaaaaaaaaaaaaatcatcctctcctctgctcactttccccccagcggtccctgagctcttgaggcttgaggcctttgcaaacgccattctctctgcctgg

SEQ ID NO: 84714 - DNA, 201 bp, Homo sapiens
cacatggcttggctccacttcagcatttgaggatggcaaatctcttctaaatcataagtagttcgggcagcaaaatcttgactttcatttcatcttatttyatgttttggtgttctcatccaatccaatcttttttatagaagatggtcaataaatcattcaaaattagaattgtagatttatgtacatcagtggtactca

SEQ ID NO: 84715 - DNA, 201 bp, Homo sapiens
atcttgcaaaagggtaaatatatgattacatagaattatatatatgaatcatcactatcaaaaagaacaaaaccccagccctaacaatgtaacaagacccratctctacaaaaaaaaaaaaaaattactaaattagctaggcatggtgacacgcacctgtggttccagctactcgggaggctgaggtgggagattcgattg

SEQ ID NO: 84716 - DNA, 201 bp, Homo sapiens
gagcaaacttctacctacttcaacctccttcattttgaagagagagaaggacagagacagggtgcaaatttgagcaagatgggaagcattcaagaagaaaytaaataactccaaacagaaaagtgggtgaatggtgactgatggctttggatgagtgaaaccaatttatctcccagaagcccctggaatgcacatggcttg

SEQ ID NO: 84717 - DNA, 201 bp, Homo sapiens
agtgacctatgattgcatcactgcacttcagcctgggcgacagaatgagacactgtctcaaaaagaacaaaaccacccttaatcagtcacggatggggaamcatgtcttttattcattcttgggtcccagagccccattcaatactgacccaggtgaggcactctgggaaaacatattaaatgaacgaaagcaggagtcat

SEQ ID NO: 84718 - DNA, 201 bp, Homo sapiens
cacacaggaggaggcttacagggcaggcttcagggccaaacttctgggctggcagcccagtccctactcacaagctctgcaaccttggccaactgactccrcctcctgggctcagcttcttcctgtaaactacagggacaatagcatccaactaatggggctgtcaagctgatcccatgagatgacatgaggtcacagtca

SEQ ID NO: 84719 - DNA, 201 bp, Homo sapiens
cttttcatcttcacagtaaccaaaaattaggtcttagaggctatttctgctcctcttcctctccagcccaactctgcattctcacttccagctgaaagctytgcctgccatttaaaaaatccttgccagacccatgtgaaccctcagctactatcctacttctctgatcccattgacagatgaacaccttatcacagcgga

SEQ ID NO: 84720 - DNA, 201 bp, Homo sapiens
aagagagaaagagtggccatttggaccccgaagcagcacattatacaaccatccaatgcaatgctaacctggagcctcatacccatagacagaccacttcytgatggaagggcacagattccatctctcaacagcacccagcccttgggggaaaaaggtaaaggaagtcgatttgtttttggaatctcttgcattttggta

SEQ ID NO: 84721 - DNA, 201 bp, Homo sapiens
tctcaaactcctgacttcaagtgatctgcccacctcagcctcccaaagtgttgggtttataggtgtgagccaccgcgcctggcccagggtgacttttatcrggatcccaaaatcacattctggtgctcagctggctcctcatgtgcaggaagttggggttccagatccaaccgttctattgggatgttctaaaatttggaa

SEQ ID NO: 84722 - DNA, 201 bp, Homo sapiens
ttgtccagagataggcccatgagccaagcctggctgctcaggacccaggagattcagttctgggactttgaaaagaggctcttctgtttttctggggagcygctgagaaaatcagatgaaagcttgctggtgccagcagtacttgtcatcatgaggtgaaaagtctctccgggaatggtgccaacacagagtaatcggtag

SEQ ID NO: 84723 - DNA, 201 bp, Homo sapiens
cttcacagctcagtcagccattggataaacaggttttcagtcttcagccaggctctgaggggctggtccgccatgaaatgtggttcgagctgacatccccrttatgggtcactttaggtgtcaacttggctaggatactgtgcccagttgtttagtcaaacagcagcctagatgttgccctgaaggtatttttgatatgtg

SEQ ID NO: 84724 - DNA, 201 bp, Homo sapiens
tagtgggcctcatccaatctgttgagggccttcacagaaaagacaggttcccgaacagaaaagaattctgcttccagacctccttgacatcaactccctcrggaattttcagcctggtggcatgcagatttctggcctgccagcccccacaatcatgtaagccaaattctgaaaattgctctttgtctctctccatatata

SEQ ID NO: 84725 - DNA, 201 bp, Homo sapiens
ggcttggcccccaggaacagggacgccggccctgcctaacccacactctccacctgagatctctctgctcccttcctctctcactgaacgggtccctgaargcagttagctgaggacagaggtgatgctttgtcgatacatcatgatctcctgcaactgcctgtgggaactacctgcgccagacacagtctgataaccctc

SEQ ID NO: 84726 - DNA, 201 bp, Homo sapiens
gcccaggcagcaggtctccagccagtgcgcgggctgcaactcccggagcccgtgcgggtagtcgttgcgcgccgcttctgctccccagccctcccccaggygtcttcacgagtgcagagcccaggcaagagtttgctccccgcgacgcacatcttctccgcgcctcgggtcccccgccctgggtccttttgtgtgcgctcg

SEQ ID NO: 84727 - DNA, 201 bp, Homo sapiens
gaacataaaacgccgcacagagctaagagaagaagacagtgtgttcagctggatgatcagaggaggcagcattgtccttggtccctaaagcaagccgggcrccatgatttgaggcagcagcctgcagtgacactcgccaacaccagctctcaagcgaaagagctccctttcctactgttcttctggcttctgacgatggcc

SEQ ID NO: 84728 - DNA, 201 bp, Homo sapiens
acctctacagaggacacgaatgaataggcattcttctccgcagacgtctgccaatattccttgatcctccttcactgcctcagcatccaatgtgcccctargagaagtcatgtatcaggacactgctggggctcggccaagtgcacggcttggtcattgtgtttatttttcctcaactttttccaagtcagcagatgtgcg

SEQ ID NO: 84729 - DNA, 201 bp, Homo sapiens
ctgaaggcagttagctgaggacagaggtgatgctttgtcgatacatcatgatctcctgcaactgcctgtgggaactacctgcgccagacacagtctgatamccctcttgttccagatgtattacgacaaaactgaaaacatgggcctctagggagactctaatccagctgagcagatggagaagtagcacacagacattcc

SEQ ID NO: 84730 - DNA, 201 bp, Homo sapiens
agatcaaggtgctggtagattcggtgtttaataagggctcgatttctgatcatggatggtgacttctcactgcatcctcagttgtggaagggtcaaggcasctctctgggggtctcttttctaaggacaccaaccccattcatgagggctgcaaccctcatgacttaatcacccctcaagggccccacctcctgacatcat

SEQ ID NO: 84731 - DNA, 201 bp, Homo sapiens
atttagttaggagcatttctaacaaaagccaggtttctgtccacttcccctggcattctggtttgcccttgaactcagcatcaagttctggggttagcccrtgtggcatcttgctcgcctcctactgatcttcttgcaccaccatagtgaggaccacatgtgcacaggcacgcgcagagagatcctatcagtcgcagcaac

SEQ ID NO: 84732 - DNA, 201 bp, Homo sapiens
ggcccccagggtggtggaggggagagtgtgagctttgtcccagtcttgctgatggttttcagcccatttcttcctctgtacacaaaggtaaggcaagatgygctctgcaaagaaggaggtcttccctgctttcattccatcagcaaatttactaaagaccatctgtgagccaggtactgtttttggcaccagggaacaaga

SEQ ID NO: 84733 - DNA, 201 bp, Homo sapiens
tgagggccttcacagaaaagacaggttcccgaacagaaaagaattctgcttccagacctccttgacatcaactccctcgggaattttcagcctggtggcaygcagatttctggcctgccagcccccacaatcatgtaagccaaattctgaaaattgctctttgtctctctccatatatatatctctggagggacattgccc

SEQ ID NO: 84734 - DNA, 201 bp, Homo sapiens
ggtgtggcccacgttccaaagggctacctgagtgctgcctggctgctgccccagtgaagtggtgaagcgctgccaccacccctctgttcccatcgcccaaygaagcctccttcccccaacaagagctccttgttcactacagagcaacagaagctgtcaggcactactagaggttgactctaaagcaaccctagtttgcaa

SEQ ID NO: 84735 - DNA, 201 bp, Homo sapiens
taggaggtcgaggctgcagtgagctgtgatggcgccactgcactccagcctctgggcaatagagcaagactttgtctcaaaaaaaaaaatgcagacatctyattaatacttgtatacacttttatttttggacccagtcacccttccgtgccatacttatgggtttacttgttcttttggacactgcagagtatccattga

SEQ ID NO: 84736 - DNA, 201 bp, Homo sapiens
cccacaatcatgtaagccaaattctgaaaattgctctttgtctctctccatatatatatctctggagggacattgcccataacttctgtttatcctccatraaagtccatggcccccaagagcaaccaaatatttcctttggcaaccgcacttctgatatatgcataatctgcagacatgcacacaccctgttggttctgt

SEQ ID NO: 84737 - DNA, 201 bp, Homo sapiens
tttatttttggacccagtcacccttccgtgccatacttatgggtttacttgttcttttggacactgcagagtatccattgaatgaacacacaatggcttayctaacactgacttttggatggacgtttaggttattcccactcagtcactgttacaaacagtgctgcatcctcctacaaaagtctccgcgtgcttgtttct

SEQ ID NO: 84738 - DNA, 201 bp, Homo sapiens
tccataaaagtccatggcccccaagagcaaccaaatatttcctttggcaaccgcacttctgatatatgcataatctgcagacatgcacacaccctgttggytctgtctctctagagaaccctgactcctacaggccccagctacctggtatctgtttcttcagtctgctcatagaggacagccgcagtgtacaaggacatc

SEQ ID NO: 84739 - DNA, 201 bp, Homo sapiens
gcaaccgcacttctgatatatgcataatctgcagacatgcacacaccctgttggttctgtctctctagagaaccctgactcctacaggccccagctacctsgtatctgtttcttcagtctgctcatagaggacagccgcagtgtacaaggacatcagcacacggaccccttgttcaccacctgtccccttactatcttatt

SEQ ID NO: 84740 - DNA, 201 bp, Homo sapiens
caaccgcacttctgatatatgcataatctgcagacatgcacacaccctgttggttctgtctctctagagaaccctgactcctacaggccccagctacctgrtatctgtttcttcagtctgctcatagaggacagccgcagtgtacaaggacatcagcacacggaccccttgttcaccacctgtccccttactatcttattc

SEQ ID NO: 84741 - DNA, 201 bp, Homo sapiens
ccctgttggttctgtctctctagagaaccctgactcctacaggccccagctacctggtatctgtttcttcagtctgctcatagaggacagccgcagtgtayaaggacatcagcacacggaccccttgttcaccacctgtccccttactatcttattcttggcaacttatccatgacaataggatgggatatgtttttctct

SEQ ID NO: 84742 - DNA, 201 bp, Homo sapiens
ggaaaggctctgaaaggtgaaaagcacccaaagttcaagacccctgactgaggcacaagaatcaaggctccttctcgtgcccagaacagctgccgctgggwcagggagaaatcacacctggtggagaagtttggagagggagaccagtccatgaatgaagagggcgtgacagcaggagaggggaacatgtgacaggtgggg

SEQ ID NO: 84743 - DNA, 201 bp, Homo sapiens
aggctctgaaaggtgaaaagcacccaaagttcaagacccctgactgaggcacaagaatcaaggctccttctcgtgcccagaacagctgccgctgggacagsgagaaatcacacctggtggagaagtttggagagggagaccagtccatgaatgaagagggcgtgacagcaggagaggggaacatgtgacaggtggggttgt

SEQ ID NO: 84744 - DNA, 201 bp, Homo sapiens
caaagttcaagacccctgactgaggcacaagaatcaaggctccttctcgtgcccagaacagctgccgctgggacagggagaaatcacacctggtggagaartttggagagggagaccagtccatgaatgaagagggcgtgacagcaggagaggggaacatgtgacaggtggggttgtgatctaatggggagacagaaccac

SEQ ID NO: 84745 - DNA, 201 bp, Homo sapiens
tcaaattgcagtcttgcctgagatattttaaagatgacaacagacctatctacacatctacagagtttcaggaaggaagggaaggagggagggaaaagaarggaaaggaaagagggaaagaagggagggggagagggagggagggcaggaggaagtttggagggtaagaaagaaaggagggaggcaggaagggagggaagg

SEQ ID NO: 84746 - DNA, 201 bp, Homo sapiens
agggaacagaacttagaggtgtctgatccaagtcccagatcttagagatggggaagccaatgccagagagttggtgacccaggcaaggtcaagccctctgyatggcctgcaagatgatgtgcctgcaggaggggttccctgaacactgggagtcatcaaagcctccccctgtcagagccacactctctccacatggcccca

SEQ ID NO: 84747 - DNA, 201 bp, Homo sapiens
ggtcaccatctccttgtccaccgctgtggtcccagtacctaggctggggcctgacaggtggtagatgctccacagaggtgctcgctgccctccccgcattmtcttgtttcatcttcacagctccactgtgtgagtgctgccgttatccccactttccgaatgcagaaaccgagactcagaaggggaggtggcttgccagag

SEQ ID NO: 84748 - DNA, 201 bp, Homo sapiens
agaccagcctgggcaacatagcaagactccatccctacaaaaaaaaaatttttttaattagctgggcatggtggtgcacacctgtggtcccagccactcargaggctgaggtgggaggatcacttgagcctaggaggtcgaggctgcagtgagctgtgatggcgccactgcactccagcctctgggcaatagagcaagact

SEQ ID NO: 84749 - DNA, 201 bp, Homo sapiens
agggagactctaatccagctgagcagatggagaagtagcacacagacattccatgggtatagacccgggatcaggccacaggccaaacctggcctactacytgattttgcaaataaagttttattggcacacagctgcacctttgttacgtgtcatccatggctgctttcttgcaacaacggcagaattgagaagtggcaa

SEQ ID NO: 84750 - DNA, 201 bp, Homo sapiens
tcgaacccgggaggtggaggttgcagtgagccgagattgcgccactgcattccagcctgggcaacacagtgagactccatctcaaaaaaaaaaaaaaaaaraaaaaaagggatagctggattcttgaatccaaaatgccagaaacacaattactacagaaacaaaaagtacctgggccttatcacagtcccacatatgaat

SEQ ID NO: 84751 - DNA, 201 bp, Homo sapiens
gagttggctgcggcggtcataaactttcagagcgcgctgcccatccctgcgcggagctggccggctgtggctcgggcttttctggcttctgcaccaccccygtcgcctccccgccccccagaggggctggaactgcctcgccgggcctttgaacccgggcgcactgggggtcgcctcccaggcgctggggggagctggcca

SEQ ID NO: 84752 - DNA, 201 bp, Homo sapiens
cctgtagtcccagctactcaggaggctgaggcaggagaattgcttgaacccaggaaatggaaggttgcagtgagccgagatcgcgccactgtactccagcytgggcaacaacaagactctgtctccaaaaaaaaaaaaaaaaaagaaaagaaaaagaagaaaaatactttatttactttataacctcaggggccgacagtt

SEQ ID NO: 84753 - DNA, 201 bp, Homo sapiens
tcagctgcagcttttctgaaggcagtcttagggagaatggaggcaggagttttaaaggtcataaaaatttcaagcgaaagagatgctccaaatctcttagraaaaattgtcaacagaaaagaaaggaaataaaggtcacatgattatgaaatggaagggcacaaaccccaaggtggcattcattttgcatttaagtcctgt

SEQ ID NO: 84754 - DNA, 201 bp, Homo sapiens
ctgtctcacaatagagttatgaataagatctcatggttagcagtagccttagacatgtggggaagcaagctatgggctgcatgaggaaataattacataayccaaaaaggaggccagaggttgtctaagtaagcttggagaaacaataattccaaaataagctgagaccaactttgtagcgtaatgaacattcaaagctgt

SEQ ID NO: 84755 - DNA, 201 bp, Homo sapiens
gcagggaagagagaaagagtggccatttggaccccgaagcagcacattatacaaccatccaatgcaatgctaacctggagcctcatacccatagacagacsacttcctgatggaagggcacagattccatctctcaacagcacccagcccttgggggaaaaaggtaaaggaagtcgatttgtttttggaatctcttgcatt

SEQ ID NO: 84756 - DNA, 201 bp, Homo sapiens
tgagcaaacttctacctacttcaacctccttcattttgaagagagagaaggacagagacagggtgcaaatttgagcaagatgggaagcattcaagaagaamttaaataactccaaacagaaaagtgggtgaatggtgactgatggctttggatgagtgaaaccaatttatctcccagaagcccctggaatgcacatggctt

SEQ ID NO: 84757 - DNA, 201 bp, Homo sapiens
ccctgacccagaccgcatgcacgcacacacacacacacacacacacacacacacacagtctcaacttatctcaaacaacatgtgtgtactttaactggagscttcaatgcctcagccaaagttgggaatttcaagcatctcagcagatacatgggagagatgcttttgaataagttaagtcaacatgccacaaacacacct

SEQ ID NO: 84758 - DNA, 201 bp, Homo sapiens
gaaaagatgctcagtatcttcagtcatcagggaaacgcaagctaaaactgcaatgaaatactgccatatatcattagaatagcaaaagttttaaagatacytgacaataccaagtgttggtgaagatgtggggcaactggaacttccatacattgtaggtggaaatgtaaaatggtaaatccactttggaaaacagtttag

SEQ ID NO: 84759 - DNA, 201 bp, Homo sapiens
gagctgaacatgaagttgggctccaaacctaagttgccactcttaaacatcaaaagcagtggttaaaaatagaggaatttatagagtgcaggtgattcatygttgttgaggcttgtgggtccacccccccacaaaaaaaaacagctagctttttttccttacatgaaactatttaaacttctgtccccagcgctagagaaa

SEQ ID NO: 84760 - DNA, 201 bp, Homo sapiens
ctggggaaatacctatgctgtttgacttaggatggggttacatcgtgataaacccactgtaagttgaaaatactgtaagtctaaaatgcatttaacacacytaagcaactgaacatcatagcttagcctagcctatcttaaatgtgctcagaacacttacattaacctacagttgggcaaagtcatctaacacaaagccta

SEQ ID NO: 84761 - DNA, 201 bp, Homo sapiens
atctgttgagggccttcacagaaaagacaggttcccgaacagaaaagaattctgcttccagacctccttgacatcaactccctcgggaattttcagcctgrtggcatgcagatttctggcctgccagcccccacaatcatgtaagccaaattctgaaaattgctctttgtctctctccatatatatatctctggagggaca

SEQ ID NO: 84762 - DNA, 201 bp, Homo sapiens
aagccttagcccaaactgtttacactcttccatggcctattaccataaggctgagattaaaaagaatctcaaagtcgcagcatttatcatctcatcagctmattggaccatagacctattcctcccctaacacaggcacctgcacacttaaggatacttggaggaagcaccagggggtcaaaggaaaggagaacaacagaa

SEQ ID NO: 84763 - DNA, 201 bp, Homo sapiens
gtactcagccatgctctgcaatttattttccgagtgcaattaatttctattccaaagtgggcaaaagtctgtgtgtatgtgtgtgtgcatttccaattttsaggaactctgtttcaactgaaacatgacaaggaaggagaccaggtcactttctcatgcaaaacagagaccatccacttccaatacactggaacgcggggt

SEQ ID NO: 84764 - DNA, 201 bp, Homo sapiens
ggcaaagccagaatctgtgatgctgcccttttgtggtagaatacattaaaatacaagtttaaatgttttgttaatgctttttttttttttttttttttttyactctttatgcatttaggggagaaaaaaactcaaaagaaatggcattcctgctggattaagtttagtgtggcttgatccagggcagcctgggaagccggc

SEQ ID NO: 84765 - DNA, 201 bp, Homo sapiens
gcaatctcagctcactgcaacctctgcctcagcctcctgagtagctggggttacaggcgggtgccactacgcccggctaatttttgtacttttagtagagrcagggtttcaccatgttggccaggatggtcttgaattcctgacctccagtgatccgcccacctcagcctcccaaagtgctgggattacaggcgtgagcca

SEQ ID NO: 84766 - DNA, 201 bp, Homo sapiens
gggaggcaggaagggagggaaggaggccatttgggaagttctgcctcataaaaattattttacctgtctaatttcaaaatgctcaagtctggctattgtcrtttttgtttcccaagtagctcaggggatgcccaaacaccagatttaatccttctttcatcatgtttaaattgaaccagtgtcgggaaggaagggaagagg

SEQ ID NO: 84767 - DNA, 201 bp, Homo sapiens
tgactgcccagtgccctccattctatgaagtgaatttgatcagagcacaatgatgcaggataagaatcagaaagggcagtgccaaggtgcaggggctacarggaaaggtgactcccctcgctatctgaggataagaggcaattgatgatggcccaacactcacagcttctatcttccccacaaagggaaagaaacagggag

SEQ ID NO: 84768 - DNA, 201 bp, Homo sapiens
attctatgaagtgaatttgatcagagcacaatgatgcaggataagaatcagaaagggcagtgccaaggtgcaggggctacaaggaaaggtgactcccctcrctatctgaggataagaggcaattgatgatggcccaacactcacagcttctatcttccccacaaagggaaagaaacagggaggcacctcccatcctctagg

SEQ ID NO: 84769 - DNA, 201 bp, Homo sapiens
agggaaagaaacagggaggcacctcccatcctctaggtggacacagcccagccagcaaatcagggtatcacgaccagctacagaatttatgggacccaggmgaaaatgcaaatgtgcagctctttgttcagaaagtattaaggatttcaagacagtgacagcaggactttaagccgagccagagtctttctgagtgcagga

SEQ ID NO: 84770 - DNA, 201 bp, Homo sapiens
gaggtgccgatgacacaaggtaggtaagtgagccccatgaaagctgctaccaagggctcagaggttatggggcttggggataaaggtgaccgtgaggaacytgaatcaagacggctccgggacacggtggcaaaggtgcctttccaggcttccaggggcttgcattcacaaccatctctgagttctcagctaagaatccct

SEQ ID NO: 84771 - DNA, 201 bp, Homo sapiens
tccacatggccccaggagaaggctgacttccccactggacgaaccccaagacaaattcaggatggtgctgtctaggccctagggtaagagagtttctaagractgcaggagagaagggaaggccctctgtgaccatggcagtgggtgactggagccagcctgtggaaggcccaaggacgagctgatgtgaattcaccctgc

SEQ ID NO: 84772 - DNA, 201 bp, Homo sapiens
ggaaggccctctgtgaccatggcagtgggtgactggagccagcctgtggaaggcccaaggacgagctgatgtgaattcaccctgccttggcatccaggggsgcccacaggaaggaagggagcccatcccaggggaattctaccccgagtggactgtgcaggttctgtcaggctcagctaaacccacccttagactccctgg

SEQ ID NO: 84773 - DNA, 201 bp, Homo sapiens
cttggcatccaggggggcccacaggaaggaagggagcccatcccaggggaattctaccccgagtggactgtgcaggttctgtcaggctcagctaaacccayccttagactccctggagaccaggatgctttcaaggaattttaaaccccttggatcctggtggggtcaacagtgagtatgagcccccttggcccctgggga

SEQ ID NO: 84774 - DNA, 201 bp, Homo sapiens
tcaggctcagctaaacccacccttagactccctggagaccaggatgctttcaaggaattttaaaccccttggatcctggtggggtcaacagtgagtatgarcccccttggcccctggggaatgagataaactttcggggctttctctatctcagaaaagaggctcagagagacatctcaggtatctaatccccctggtcag

SEQ ID NO: 84775 - DNA, 201 bp, Homo sapiens
accaccatgcccagctaatttttgtatttttagtagaggtggggtttcatcatgttggccagactggtctcgaactcctggcctcaagcaatcagcccacyttggcctcccaaagtgctgggattataggtgtgagccactttgcccggcctttttttcctgttttcttcagtgctatttcctcagctcctaggacagtgc

SEQ ID NO: 84776 - DNA, 201 bp, Homo sapiens
caggctcagctaaacccacccttagactccctggagaccaggatgctttcaaggaattttaaaccccttggatcctggtggggtcaacagtgagtatgagyccccttggcccctggggaatgagataaactttcggggctttctctatctcagaaaagaggctcagagagacatctcaggtatctaatccccctggtcagt

SEQ ID NO: 84777 - DNA, 201 bp, Homo sapiens
gggaaggagcaatgccagcctgtccaagaaacctgctgagtaaaagccatccttgaaatttgcccctcgtgtttggtggagattattcaacaccagtgccrtcagacaggctctttgccaccatgagctggagagaactggaatccctgggaccagaactcagtgtccagaacaagcacatctcactgagacttcacaaaa

SEQ ID NO: 84778 - DNA, 201 bp, Homo sapiens
aacagttcataccagagatgaccagtggtttggaaaagccagatcatttgccatttctcctttttaaaaggtctttggggacatgattaacaaaagctaaratgggaggaaaggacagaaatgagagcctcaaggtttgttttttttttttttaatgttttcaacgagctgtgacttgaaacaagaggccagacctgggca

SEQ ID NO: 84779 - DNA, 201 bp, Homo sapiens
aaacagaaaagtgggtgaatggtgactgatggctttggatgagtgaaaccaatttatctcccagaagcccctggaatgcacatggcttggctccacttcascatttgaggatggcaaatctcttctaaatcataagtagttcgggcagcaaaatcttgactttcatttcatcttatttcatgttttggtgttctcatccaa

SEQ ID NO: 84780 - DNA, 201 bp, Homo sapiens
tgaaaccaatttatctcccagaagcccctggaatgcacatggcttggctccacttcagcatttgaggatggcaaatctcttctaaatcataagtagttcgrgcagcaaaatcttgactttcatttcatcttatttcatgttttggtgttctcatccaatccaatcttttttatagaagatggtcaataaatcattcaaaat

SEQ ID NO: 84781 - DNA, 201 bp, Homo sapiens
gaagtaaggaaatgaacggtgagagggcagcaaaaaccaatgggacggaggagaagccactgcgggtgggggaaggaagaacagaaatctaagctggctgycggattctggaactttcaaaacctaaaataaggaatggacttcacagaacttctcaagctagggcacagacgcattttcttctgaaagaaatttcacaat

SEQ ID NO: 84782 - DNA, 201 bp, Homo sapiens
aagagatgccatctgccccactggagagcctcgggttgaaggcgaagccgtggaagacggaccagagcctggaggggatcaggcctgcagtggcatcgtcrgaggcactgcatcacgcctcacctgaacgagacatgcatccgggcaccccaatccctatgttctaagcccatttccatctatctttcacttggaacaaca

SEQ ID NO: 84783 - DNA, 201 bp, Homo sapiens
acacagttaaacaaaagagtaacacaatcaagcccggaagtcataattcagattcagaaatgcagggggggcaggatttgacctggtaccttctcagagaygtaggactccgagagagcaaaatctcctgccggaacgtgctgatggattggggaggaaatgggaatcatttggctttaaaaaaaaaaaaaaagaaaaaaa

SEQ ID NO: 84784 - DNA, 201 bp, Homo sapiens
tcagagccagtgactcatcagcaacgttggttggagcttccaggaaagagatgccatctgccccactggagagcctcgggttgaaggcgaagccgtggaaracggaccagagcctggaggggatcaggcctgcagtggcatcgtcggaggcactgcatcacgcctcacctgaacgagacatgcatccgggcaccccaatcc

SEQ ID NO: 84785 - DNA, 201 bp, Homo sapiens
ttaagtgagatacatgtgtatgataatatgcacatcctaataactgtacaaaaataagctgttattatttttgttacaatgaccacagtgataaaaatatytggggacccaccctccccaaccccgctccacctgactggttgagtggctggccctagttctgttccatgtttatgcatccagcaaacacttgaatacctc

SEQ ID NO: 84786 - DNA, 201 bp, Homo sapiens
gacagtcctggagtccctgaggctgccagtttttcagagaagctcaaaagatggattattatgggaacctaattttttttttttttaaggcaggcagaccrttcctgtgagtagcaaaacaaacttgtccttgggcagaagctgaccggcaggctgccagtttaggcctcaaactaccttcccttctctctctttctgctt

SEQ ID NO: 84787 - DNA, 201 bp, Homo sapiens
cacatccatattcatatccatgtctatagtacagatatatctgtactatatccgtatctatactatagctatctatatctacagccatagctacagctacytcatgtttttcctttatacatccttcattgggaagctctgtaaaacttgtatttctgttgtatgcctgtaccccaagtttattcaagcaagtcttctgta

SEQ ID NO: 84788 - DNA, 201 bp, Homo sapiens
atttcaagcatctcagcagatacatgggagagatgcttttgaataagttaagtcaacatgccacaaacacacctgtgtgttttaattaccttgaagtagcyttgacttttatcagaggaatttttcacaagctgtatccctttaaagttcatatagtgatgagtccctgtgtccaccaaatgcagccaatcactggatgtg

SEQ ID NO: 84789 - DNA, 201 bp, Homo sapiens
tagaggtcttgtcccctggtctgaaagacattccacccctcaggtttactaccctcgtctgcacttcatttttgaggtgccgatgacacaaggtaggtaastgagccccatgaaagctgctaccaagggctcagaggttatggggcttggggataaaggtgaccgtgaggaacctgaatcaagacggctccgggacacggt

SEQ ID NO: 84790 - DNA, 201 bp, Homo sapiens
cctgacccagaccgcatgcacgcacacacacacacacacacacacacacacacacagtctcaacttatctcaaacaacatgtgtgtactttaactggagcyttcaatgcctcagccaaagttgggaatttcaagcatctcagcagatacatgggagagatgcttttgaataagttaagtcaacatgccacaaacacacctg

SEQ ID NO: 84791 - DNA, 201 bp, Homo sapiens
caaagttgggaatttcaagcatctcagcagatacatgggagagatgcttttgaataagttaagtcaacatgccacaaacacacctgtgtgttttaattacyttgaagtagccttgacttttatcagaggaatttttcacaagctgtatccctttaaagttcatatagtgatgagtccctgtgtccaccaaatgcagccaat

SEQ ID NO: 84792 - DNA, 201 bp, Homo sapiens
tcaggattcaaatttgactccacatgattccagggacagagttcataatgcttaagcagcgctgcctctggaactcatacccaaggttttaatggttcccrttttcttctgtgtatcattgacaactcactgcctctccatctgtctagtttccattccataatctctgatggaaggtcatgtaaaggaatgatgacctct

SEQ ID NO: 84793 - DNA, 201 bp, Homo sapiens
catacccaaggttttaatggttcccattttcttctgtgtatcattgacaactcactgcctctccatctgtctagtttccattccataatctctgatggaargtcatgtaaaggaatgatgacctctacagaggacacgaatgaataggcattcttctccgcagacgtctgccaatattccttgatcctccttcactgcctc

SEQ ID NO: 84794 - DNA, 201 bp, Homo sapiens
ctaaaaatccagaaaagttacatggacctctgctgtctcatgtagttgcttctgactctcggcaaagcaattttgcgctccccaagttgtggggcgaaacygtccaccagcgggccagtcatgtttttggttgcgtctgtcggtacttttgtcatcaatgcatatgaaatgaagctgtttctggtttttcaattactgggc

SEQ ID NO: 84795 - DNA, 201 bp, Homo sapiens
tttgcaaagtagaggaattatttgtaaagtgaaaaactttgtatcatgtctgctgcaaggagaccgagagacagtctggaggcagctctagcaacagtccrtctctcagctgagaattctactttggctcttgaaggacatcttaggaggagctttccacgcagtgattcctgagtgtgacgcaagcacaggcaggatgca

SEQ ID NO: 84796 - DNA, 201 bp, Homo sapiens
ctagcacaaatccaaattctccctcggggtcacacagggtcacaacctctttgtaccaagttttcttgctacaaatcaaactgccttccagcctcaagtcyctctgtctcccaagtggagattagttgcattccaccaagtctgtttttgttcctggaccactcacacttcctgctgactctggggcagaaaacgggcttt

SEQ ID NO: 84797 - DNA, 201 bp, Homo sapiens
gcctcatgttatgaggctttctccggccacccctcccctccattgcctctgggtctttgttcagaagcaaggcacaccacctgtaaggcagctacaagccygtggagctactggggccagccgaaatgtctctggtttctgtagaggcctgagggctccccaacctcctggctagacttggggattccccaggaggtggaa

SEQ ID NO: 84798 - DNA, 201 bp, Homo sapiens
accctcttctttcacatgcccgtctcaaaagcacatcatgaaatgatgttttctaaatagatgtctgtgggatttcctcgattgcttcctggtgactcccrgttggtgacacccacttcaggtcctgggcaatgctgggtgaagtcagaagtgaggctactggtgccccatggggtcctcagctgcaaattacaaggcatt

SEQ ID NO: 84799 - DNA, 201 bp, Homo sapiens
caagaacccaggggcccccagggtggtggaggggagagtgtgagctttgtcccagtcttgctgatggttttcagcccatttcttcctctgtacacaaaggkaaggcaagatgcgctctgcaaagaaggaggtcttccctgctttcattccatcagcaaatttactaaagaccatctgtgagccaggtactgtttttggcac

SEQ ID NO: 84800 - DNA, 201 bp, Homo sapiens
aggtggaccccagcagaacttgagcaaggactttctactcaccagccagcatcctccaatcacaggattggatatggcaggaggactggttttggcccagraagggcttctgcagggctggaggttgtgttgttatcattgtggccaccatcttcaagacgttgagtgtttactagattgtaggcgctgtgctaaccacgc

SEQ ID NO: 84801 - DNA, 201 bp, Homo sapiens
gctggaatgcagtggcgcagtctcggctaactgcaacctccacctcccaggctcaagtgagtctcgtgcctcagcctcccaagcagctgggattacaggcrtgcaccaccatgcccagctaatttttgtatttttagtagaggtggggtttcatcatgttggccagactggtctcgaactcctggcctcaagcaatcagcc

SEQ ID NO: 84802 - DNA, 201 bp, Homo sapiens
ttatttttttgacagagtcttgctctgacacctaggctggaatgcagtggcgcagtctcggctaactgcaacctccacctcccaggctcaagtgagtctcrtgcctcagcctcccaagcagctgggattacaggcgtgcaccaccatgcccagctaatttttgtatttttagtagaggtggggtttcatcatgttggccag

SEQ ID NO: 84803 - DNA, 201 bp, Homo sapiens
tgccattttccattagctccaacaagggagatgagactggtgacctggtagaaagaaaagcaatctattggatatcagtattcagaactggggaaatacckatgctgtttgacttaggatggggttacatcgtgataaacccactgtaagttgaaaatactgtaagtctaaaatgcatttaacacacctaagcaactgaac

SEQ ID NO: 84804 - DNA, 201 bp, Homo sapiens
aaatccttcatccaggttgtcagcaagaacattaagcggaagagttcccaggagtttttggagagtcaattactatttggttgagattttcaaaccacttkttcactaacctatcaatcactttgtaatatttattgaccacttcctgggcctctgctaggaggtgtcaggagtagccctcagctacaagaatctcatagt

SEQ ID NO: 84805 - DNA, 201 bp, Homo sapiens
gggttgaagtcttttttcgttttggtttttggatatagagtcttgctctgtcacccaggctggagtgcagtggcgtgatctcggctcactgtaacctctayctcccaggttcaagcaattcccatgcctcagcctcccgagtagctgcgattacaggcataagtcaccacacccggctcatttttccgtttttagtagaga

SEQ ID NO: 84806 - DNA, 201 bp, Homo sapiens
aatcagcagtttgagatataagatggaatatgacttagtaataataaggaacaaactaccagtataagcagtaacatgaattatgcatgaaacataatgcygaacgaaaaaagcccgatagaaagagcccaagtggtaagactccatacatataaactttaagaacaggcaaaactaacatataatgacagaaaatggatt

SEQ ID NO: 84807 - DNA, 201 bp, Homo sapiens
ccaatatgtgatttctatattattgattctcactgccattttccattagctccaacaagggagatgagactggtgacctggtagaaagaaaagcaatctaytggatatcagtattcagaactggggaaatacctatgctgtttgacttaggatggggttacatcgtgataaacccactgtaagttgaaaatactgtaagtc

SEQ ID NO: 84808 - DNA, 201 bp, Homo sapiens
tttgttgaatgcggttgttatattcaggatgcaatactacattctcagggtgtaaatggcacaagcaagtgagagagtcaaagcatgtttgtaaaaatacrtggactggcacaactcccgttctgtgctgacccaagccagcactggccacacctgttgtccttgctgttctccctagcctcataccctcaaaagaggacc

SEQ ID NO: 84809 - DNA, 201 bp, Homo sapiens
ctttcactcccggtccacacctacaccatgcgtggttcatactttctcatccttcaagcgtaagcttcatttccaggaacctccctgtctccgtgggaccyggagtgcctggaactccccttcaaagactcacaggctcatatgtgttccctcctcccagcggcaacaccaaggcaacatcacgctccacaaatgaatgac

SEQ ID NO: 84810 - DNA, 201 bp, Homo sapiens
aatgttttccacagcatcatcactctttccaaacaacctgctagttctccaccagcgaccatttttctttctttcttagtgacagagctcacattcctagyagctatgcgttgtggctgagcacatggccactaggaataaagactgcatttctcagctttctttgtagctaggagtggtcatgtgactcaatgctggcca

SEQ ID NO: 84811 - DNA, 201 bp, Homo sapiens
cttctgctaggaatgaaatatatatccatgtacagactacacaataggaagtgtgtgttttcaatgattccatatatgagttaactccttctatatttgcrttcttaacgggcgtataatataaagatgaacagtaaaattcatgctaaacattgtttctttacttggaaggacactaaataacaaaaaactctatgatga

SEQ ID NO: 84812 - DNA, 201 bp, Homo sapiens
aagaaccctctcttggggtctggatcgggacccctttccagtaatagctccaatagatttatcacttacctcaaactactgagtctctattagagacacargctttatcctcaagcaagatgccagggctgggattagggtgaggcaggtgaggtaagtggagcaagctcagggctggatcctgcctttactaaaaacaat

SEQ ID NO: 84813 - DNA, 201 bp, Homo sapiens
gtttccacaggtcttgggtccaggaaaaaagggttaattggatcctctgctctggggcttcccaggctgaaatcaaggtgttagctgaagttgcaattccyatctgagtttctgctaaagccaagtaccacttagattattatttacttaaatttttcattaataaactcactttttataaaactcagtcttgccctaagc

SEQ ID NO: 84814 - DNA, 201 bp, Homo sapiens
aagctcaactgtacaaaattatatatattttgtatatatgtgtgtatgtgtgtgtatatatatacacacacacatatacacacacatatacatatgtatayacacacatatatgtacacacacatttatacttatatatatgcacatacatatatgtacatatatgtgtgtgtatatatatacacacatacatatacgtat

SEQ ID NO: 84815 - DNA, 201 bp, Homo sapiens
cccttttgaaatggttagaaagaaccaagtcaagaaactaggctattaaataaaagttctgccagccaggtgtggtggtggatgtctgtaattgcagatcytcaggagactgaagcaggaggattgcttgagcccggggtttaaggctgtgctgtgatggtccctgtgaatagccactgagctctggcctgtgcaatatag

SEQ ID NO: 84816 - DNA, 201 bp, Homo sapiens
aactgtacaaaattatatatattttgtatatatgtgtgtatgtgtgtgtatatatatacacacacacatatacacacacatatacatatgtatatacacayatatatgtacacacacatttatacttatatatatgcacatacatatatgtacatatatgtgtgtgtatatatatacacacatacatatacgtatatgcgc

SEQ ID NO: 84817 - DNA, 201 bp, Homo sapiens
tggggacctcaaggtgagcccaggaatctgcattttaactcacatcaaggactctgccccagcaggtgcacatacactggcgtttgggaaccactgagtcstttacctcattggtgctacgcaggaatcacctggagttcttactgaaatggagattctggttcagcagggctggggctgggcctgggcctgaaattctgt

SEQ ID NO: 84818 - DNA, 201 bp, Homo sapiens
acgccatggacttcatgctttcaacctcctgtatctttaaccagatcccattatcagccagccgtctagctgggaagtgctccagccagctatttgtggcktatctttgctgaaaagactaaagaaaagaaaatagactccttcagactcttcacttagtggtttccccttccagacacagaggagcagtctttcctccca

SEQ ID NO: 84819 - DNA, 201 bp, Homo sapiens
tgtactaacaactcctgaattctatactttaaaggagggaatcttatggcatgtgaattctatcttaatataattggctatgaaaaggaaagttgctgtckggaaaaaaaaaaaaaatcatcctctcctctgctcactttccccccagcggtccctgagctcttgaggcttgaggcctttgcaaacgccattctctctgcc

SEQ ID NO: 84820 - DNA, 201 bp, Homo sapiens
atatgaatgctttccaaaaatttgagtccttttgtattttaatacaaaaggattaaactcaccacaggtagttctaatgtgtgttaatatgtttaagactrgaattttttgtgggggttggtagaagtatatggtatgaggtgggaaatttcactttttttcaggggatatgccaattattctaactttgcttctcaaaca

SEQ ID NO: 84821 - DNA, 201 bp, Homo sapiens
ccagtaatagctccaatagatttatcacttacctcaaactactgagtctctattagagacacaggctttatcctcaagcaagatgccagggctgggattarggtgaggcaggtgaggtaagtggagcaagctcagggctggatcctgcctttactaaaaacaatatttggtcgattatgaatttttttttgcactcatttt

SEQ ID NO: 84822 - DNA, 201 bp, Homo sapiens
gtgagcacagcaagaagtgaaataaaggcagttgttagttttggacaagtgttaactcttctgctaggaatgaaatatatatccatgtacagactacacartaggaagtgtgtgttttcaatgattccatatatgagttaactccttctatatttgcgttcttaacgggcgtataatataaagatgaacagtaaaattcat

SEQ ID NO: 84823 - DNA, 201 bp, Homo sapiens
acaacacatatttaatatcttatagtttccacaggtcttgggtccaggaaaaaagggttaattggatcctctgctctggggcttcccaggctgaaatcaargtgttagctgaagttgcaattcccatctgagtttctgctaaagccaagtaccacttagattattatttacttaaatttttcattaataaactcacttttt

SEQ ID NO: 84824 - DNA, 201 bp, Homo sapiens
accagagagggacattaggaaaaaatgagtgcagtttgaattagccatggagttcagttaatagtaatgtgccgatgttagctttgcagctgtggcagacrcactacagaaatgtaagatgacatatatacaacaagagaagaacctgtgtgagaggcttacaggaactccctgtactttctttgcaacttttctgtaact

SEQ ID NO: 84825 - DNA, 201 bp, Homo sapiens
atcttcacaaattgtgaggtagtcaccatcatccccacctcataggtaaggaaattgaaacttgagaaagttataggacagactgaagtgcaaacttatargtcctctgattccattcggcaatgttttccacagcatcatcactctttccaaacaacctgctagttctccaccagcgaccatttttctttctttcttagt

SEQ ID NO: 84826 - DNA, 201 bp, Homo sapiens
gtactggatgtcttctgtatcctgatcttgttggtggctgtgagtatagacatatgtgaggtccatcaagagatacacttaatatttgtatatctatgtgyatatgcatacaaagcaataatacacattttgcaaaaatgaaaacaaatgattaacgcatctgtatggtggtcagtggggcagagggaaaagggactggag

SEQ ID NO: 84827 - DNA, 201 bp, Homo sapiens
gccccctcggccgcctgctcctgcccagggcttccagggcttggaccctgcagtgctgtcggggccacagtcccctcgccagggccagccacagtctcctmgccagggccagccacagtctcttcacagtccccctcagatctggctgcagtgggggcctgggacacgccgcgcctgccagcatccccagactgggagcaa

SEQ ID NO: 84828 - DNA, 201 bp, Homo sapiens
atagagtgctatctattcccccactctctagatggggacactgaaggtctcagaggtgacatctcctaagtggcagatccagatttcagcccaggcattcdagcccacagtttgagctcttaacccctacaaagggatctgttcctcctccacgtgacaatttggatgagtgggccccaggccccattcctctctaaaccc

SEQ ID NO: 84829 - DNA, 201 bp, Homo sapiens
tggtatctgtttcttcagtctgctcatagaggacagccgcagtgtacaaggacatcagcacacggaccccttgttcaccacctgtccccttactatcttaytcttggcaacttatccatgacaataggatgggatatgtttttctctgatttgggactttgattttgttggcagtggtgggatggcttggggactgtgggg

SEQ ID NO: 84830 - DNA, 201 bp, Homo sapiens
caggatgcatgagacagaattttaaacagatcacagggtgttggttgagactctcagacatgtctcaagtcatcacttcctccccagccagtgctccgggrtttggtaaacaggcaacgaatgaaagagatggtttccaaatcctctcccacctgcccaccaccccaggttcctgtctgtcattccattagctttcttctt

SEQ ID NO: 84831 - DNA, 201 bp, Homo sapiens
tcgtctgcacttcatttttgaggtgccgatgacacaaggtaggtaagtgagccccatgaaagctgctaccaagggctcagaggttatggggcttggggatraaggtgaccgtgaggaacctgaatcaagacggctccgggacacggtggcaaaggtgcctttccaggcttccaggggcttgcattcacaaccatctctgag

SEQ ID NO: 84832 - DNA, 201 bp, Homo sapiens
gcagcgcctggatcggtggtgctcaggggccccctcggccgcctgctcctgcccagggcttccagggcttggaccctgcagtgctgtcggggccacagtcycctcgccagggccagccacagtctcctcgccagggccagccacagtctcttcacagtccccctcagatctggctgcagtgggggcctgggacacgccgcg

SEQ ID NO: 84833 - DNA, 201 bp, Homo sapiens
agaaggcagattgaggggctcctaagctgagtgtgcagacccctcaacacccgccacccccaaacacctgaggaggggggtggagcaagcaaaatgtctgmaaagtttccaaagctctgcgcagtttctgaaaagtttccaagctatctgcacactctgtgaaaagcttgcaagctatctgcacccgttgaaaacttgcat

SEQ ID NO: 84834 - DNA, 201 bp, Homo sapiens
cctgttgtccttgctgttctccctagcctcataccctcaaaagaggaccttgaaatcccccctccaaacagccactgcccctgtgccaattgcaggggaargatgtggagggtgaaggccaatgctgagcagacccagctatcatttctagaaccatcctctgcttttcaaaatgtcaagtctgttctactggaatagagt

SEQ ID NO: 84835 - DNA, 201 bp, Homo sapiens
acccctcaacacccgccacccccaaacacctgaggaggggggtggagcaagcaaaatgtctgcaaagtttccaaagctctgcgcagtttctgaaaagtttscaagctatctgcacactctgtgaaaagcttgcaagctatctgcacccgttgaaaacttgcatgcattttgcatactttctgcaaactttgccagggtttg

SEQ ID NO: 84836 - DNA, 201 bp, Homo sapiens
aactcacatcaaggactctgccccagcaggtgcacatacactggcgtttgggaaccactgagtcctttacctcattggtgctacgcaggaatcacctggasttcttactgaaatggagattctggttcagcagggctggggctgggcctgggcctgaaattctgttgatgcagcagattccggggccacacattgagtagt

SEQ ID NO: 84837 - DNA, 201 bp, Homo sapiens
actgaagcaggaggattgcttgagcccggggtttaaggctgtgctgtgatggtccctgtgaatagccactgagctctggcctgtgcaatatagcgagatcycatctttaaaagataaagaagttctgccaagttgtatactgtaaatcttaattgaaatttgtcaaggtttgcccatccctgggatcgtgaaactggggaa

SEQ ID NO: 84838 - DNA, 201 bp, Homo sapiens
cctgaggaggggggtggagcaagcaaaatgtctgcaaagtttccaaagctctgcgcagtttctgaaaagtttccaagctatctgcacactctgtgaaaagyttgcaagctatctgcacccgttgaaaacttgcatgcattttgcatactttctgcaaactttgccagggtttggcacagcctctgaatagttcgcaaactt

SEQ ID NO: 84839 - DNA, 201 bp, Homo sapiens
ctgagtcctttacctcattggtgctacgcaggaatcacctggagttcttactgaaatggagattctggttcagcagggctggggctgggcctgggcctgarattctgttgatgcagcagattccggggccacacattgagtagtgagggtttaggttagtggttctcagccctgactaaatattggcatcacctggggagc

SEQ ID NO: 84840 - DNA, 201 bp, Homo sapiens
gcagtttctgaaaagtttccaagctatctgcacactctgtgaaaagcttgcaagctatctgcacccgttgaaaacttgcatgcattttgcatactttctgmaaactttgccagggtttggcacagcctctgaatagttcgcaaactttctgaaaagtccccagtttcatgaaaaattgaccaagtcggcccaggcagcagg

SEQ ID NO: 84841 - DNA, 201 bp, Homo sapiens
ggttagtggttctcagccctgactaaatattggcatcacctggggagcacttcgatctaagctgccggggccctgcccccaggaatcatacaattgttttrgaatcaaaccagtgtccccttgctcaatgtgctgaatctgacttgtgctggcttgggaaagcctaatgttacatttttaggaattgtgtgaaccagttga

SEQ ID NO: 84842 - DNA, 201 bp, Homo sapiens
gcaggtctccagccagtgcgcgggctgcaactcccggagcccgtgcgggtagtcgttgcgcgccgcttctgctccccagccctcccccaggcgtcttcacragtgcagagcccaggcaagagtttgctccccgcgacgcacatcttctccgcgcctcgggtcccccgccctgggtccttttgtgtgcgctcgcgccaggag

SEQ ID NO: 84843 - DNA, 201 bp, Homo sapiens
ctttctttgtagctaggagtggtcatgtgactcaatgctggccaatagggatgtgagtggaagagatgcctgcaacttctgggaagagtccttcaagtgartgatctgtctttgtcctttctccttcctgatggctggaatgcagccatgatggcaggagctgtaacagccctcttggacaatgaggtgaccttgggaaat

SEQ ID NO: 84844 - DNA, 201 bp, Homo sapiens
tgcatgtattaactcatttaatcctctcaatagccctaaaaggtaggtactattcttatccctatgttactgatgaggaaactggggcatagcagtggggraatttctcaatcacaaagctaggaggtggataaagtcaagactgacccatacaaagcacttcctgccacctgaggggcgtaaaacatgaacaagtacaga

SEQ ID NO: 84845 - DNA, 201 bp, Homo sapiens
gatagctggattcttgaatccaaaatgccagaaacacaattactacagaaacaaaaagtacctgggccttatcacagtcccacatatgaatcaaaagagayctggggcctccaaatatccagcagacactaaacattgatccccccaagaatgaaaggacaatattccagaaacagactcccccttacaggaggtcactga

SEQ ID NO: 84846 - DNA, 201 bp, Homo sapiens
ctactaattatgtagccagctccatcctggcacatagcaggcactccataaatgtctgaataaatcaatgaatgcccctgcagtaaatactgataaagccyaggggaatgggggaagtagctggcacaagtaaggtgaatgtgtgcatctctgccagctctcagacagcagcacaaccattaacccagctccatgctctgt

SEQ ID NO: 84847 - DNA, 201 bp, Homo sapiens
caagcttgagtagaggtctctagggtcacgcatggcattaggacgatggatggatttgggttttactacttagacttcgttggctgagcatttttctcccrgaccgagggagggaaatgtctaacactcttccaccttccttgctgaagttatttctatctctgcaatcaacgcacccctgggctgcacccttcgcacccc

SEQ ID NO: 84848 - DNA, 201 bp, Homo sapiens
ctctatgatgagagacaaaaagagagactatgaaagaaaaagaaacaatgttttcgtacctttagtgatacctttttttgctttttgatcaagagtcttayattttcatttcacactggcccctactaattatgtagccagctccatcctggcacatagcaggcactccataaatgtctgaataaatcaatgaatgcccct

SEQ ID NO: 84849 - DNA, 201 bp, Homo sapiens
ctgttctactggaatagagtcacagccttttccattccccacccgacatttctcctaaacccaatttgcattttataattacaaaaacaatgcaatcttgrgagtctataattatttcaaaattaaaaagtgacacatgctcattgaattaaaattataaaaattaaacaagcaaatatgaagtgaaagtttcccatccat

SEQ ID NO: 84850 - DNA, 201 bp, Homo sapiens
gtgttttcaatgattccatatatgagttaactccttctatatttgcgttcttaacgggcgtataatataaagatgaacagtaaaattcatgctaaacattktttctttacttggaaggacactaaataacaaaaaactctatgatgagagacaaaaagagagactatgaaagaaaaagaaacaatgttttcgtacctttag

SEQ ID NO: 84851 - DNA, 201 bp, Homo sapiens
cgatttttcttctgacttgatcctcatgcctttttccatagggaaattgaagttttatgtaaacaaatttgacaatcttggattatttgggattttgtggytttttaaatggcctttcccagcccagaattatatgaatgctttccaaaaatttgagtccttttgtattttaatacaaaaggattaaactcaccacaggta

SEQ ID NO: 84852 - DNA, 201 bp, Homo sapiens
gcttgtcgtctagagaagggaactggacagtgaacaaatacagaagctacaggtcacatgatgatagaagctatggaaaaaaagcagagtaagggatgggragtagctgggagagtgggggccattcagatgaaagagccaggatacctccttgagaagtgaaggaactggggctggagagatgcaggtatctgggggaag

SEQ ID NO: 84853 - DNA, 201 bp, Homo sapiens
ctccaacttcttcaaactcctttcttctccacaggaaccattttcaatctctttagtcatcttggccacacctccctgggcccctatccatgtcttagcattttttttttttttttaaacaagtgaccaaagcagggtttggaattccactgaaagcctgcctggtgcagggtatggctttattcatcacgatctttggaa

SEQ ID NO: 84854 - DNA, 201 bp, Homo sapiens
caatcattgaccaacatttgttgaatgcggttgttatattcaggatgcaatactacattctcagggtgtaaatggcacaagcaagtgagagagtcaaagcrtgtttgtaaaaatacatggactggcacaactcccgttctgtgctgacccaagccagcactggccacacctgttgtccttgctgttctccctagcctcata

SEQ ID NO: 84855 - DNA, 201 bp, Homo sapiens
gttgtggtgagccaagatcgtgccattgcactccagcctgggcaacaagagtgaaactctgcctcaaaacaaaacaaaacaaaccctttgggaaaacagaktaacatggaaaagtacaaacagtatacaccctccacactttgaggagtctagggtggctttcagctgcctgccatgcatgcagatttccacattttaact

SEQ ID NO: 84856 - DNA, 201 bp, Homo sapiens
gttgtggtgagccaagatcgtgccattgcactccagcctgggcaacaagagtgaaactctgcctcaaaacaaaacaaaacaaaccctttgggaaaacagamtaacatggaaaagtacaaacagtatacaccctccacactttgaggagtctagggtggctttcagctgcctgccatgcatgcagatttccacattttaact

SEQ ID NO: 84857 - DNA, 201 bp, Homo sapiens
gctccccgcgacgcacatcttctccgcgcctcgggtcccccgccctgggtccttttgtgtgcgctcgcgccaggagaggcgcgccgccccgtgcgcttacytgcggcggaggtcactgtgagcccgaaaaggagccacagccccggctccatgaacctagatcaggcgccggagcaccggaccaggaggacggccgcttgt

SEQ ID NO: 84858 - DNA, 201 bp, Homo sapiens
gtgtgcgctcgcgccaggagaggcgcgccgccccgtgcgcttacctgcggcggaggtcactgtgagcccgaaaaggagccacagccccggctccatgaacytagatcaggcgccggagcaccggaccaggaggacggccgcttgtggccgcgaaagggcactggggccgggtacagctggcctcgccctccagctgtgggg

SEQ ID NO: 84859 - DNA, 201 bp, Homo sapiens
gccatggttagatggagatttacagcattaaaatgtttatatttgaaaagaagaaaaagctaaaaacagtaaccaaagcttttacttcaataaactagagaaagaaaagtaaatttaaactcaaaggaagcagaaggaaagaaataatgaagagaaaagcagaaatcaataaaattgaaaacagaaaagaatgaagacaaa

SEQ ID NO: 84860 - DNA, 201 bp, Homo sapiens
gctgtggctcgggcttttctggcttctgcaccacccccgtcgcctccccgccccccagaggggctggaactgcctcgccgggcctttgaacccgggcgcamtgggggtcgcctcccaggcgctggggggagctggccaggagcgcagcggcccgaggcgcacccaggacagcgaggggcgggggcggcgtggcgtggcgcg

SEQ ID NO: 84861 - DNA, 201 bp, Homo sapiens
ccatggttagatggagatttacagcattaaaatgtttatatttgaaaagaagaaaaagctaaaaacagtaaccaaagcttttacttcaataaactagagaaagaaaagtaaatttaaactcaaaggaagcagaaggaaagaaataatgaagagaaaagcagaaatcaataaaattgaaaacagaaaagaatgaagacaaat

SEQ ID NO: 84862 - DNA, 201 bp, Homo sapiens
ggggtgttatcttttctatcaggggctgagggaaagacacatttctcattgttccccgagtgacaccttccccttgaagagcctgcttgccaaggaactcrgtgtactttacactcttgactcacgcctcgggctggctccctacctctcccaggagttcagagcctgcgtgtggggcagtggcctgggagcaaagtcaac

SEQ ID NO: 84863 - DNA, 201 bp, Homo sapiens
catggttagatggagatttacagcattaaaatgtttatatttgaaaagaagaaaaagctaaaaacagtaaccaaagcttttacttcaataaactagagaaagaaaagtaaatttaaactcaaaggaagcagaaggaaagaaataatgaagagaaaagcagaaatcaataaaattgaaaacagaaaagaatgaagacaaata

SEQ ID NO: 84864 - DNA, 201 bp, Homo sapiens
atggttagatggagatttacagcattaaaatgtttatatttgaaaagaagaaaaagctaaaaacagtaaccaaagcttttacttcaataaactagagaaagaaaagtaaatttaaactcaaaggaagcagaaggaaagaaataatgaagagaaaagcagaaatcaataaaattgaaaacagaaaagaatgaagacaaataa

SEQ ID NO: 84865 - DNA, 201 bp, Homo sapiens
ctgaaattaaagagggcacatcacttctgaagccacagacctaaagagataataaaggaatactgtgaccaactccacttccttaaattcaacaacttagatgaaatgaaacagttcctcgaaagataccaaatatcaaaactcaagaagaaacggataacctgaattgtcctatgtctattaaagaaactgaggccaggc

SEQ ID NO: 84866 - DNA, 201 bp, Homo sapiens
tgaaattaaagagggcacatcacttctgaagccacagacctaaagagataataaaggaatactgtgaccaactccacttccttaaattcaacaacttagatgaaatgaaacagttcctcgaaagataccaaatatcaaaactcaagaagaaacggataacctgaattgtcctatgtctattaaagaaactgaggccaggca

SEQ ID NO: 84867 - DNA, 201 bp, Homo sapiens
gttagaaaaggaccacagaaaatccaattgtctcaaaaatgtaatgggctcaatgtggaaggatgaaggtggcataacacagtacatttcaaactgcaacwtgcattggaatcacctgtgatctcgctgccatgcagatgctgagaaggaatgagattctgcatttccgacaagctccagggtgaagctgatgctgctggt

SEQ ID NO: 84868 - DNA, 201 bp, Homo sapiens
aaggaatcgacaaactaaaaccctttgggaggaccgggcacagtggctgacacctgtagtcccggcagtttgggaggctgaggcaggcggatcacctgagrtcaggagttcaagaccagcctgacccacatggagaaaccccatatctactaaaaatacaaaaattagccatgcatggtggtgcatgcctgtaatcccagg

SEQ ID NO: 84869 - DNA, 201 bp, Homo sapiens
ggtgtgtaggactggactcatctggaaagagagactctcatgtctccttttactatcaaaacacacgcacagaccaaaatgcacagatgcatgggacatamtgggctgaaataaagattctgggaatctctcaattatttaaaagtatttaaattatttaattattccttagcaacaggggaagcctagatggaaatgtgt

SEQ ID NO: 84870 - DNA, 201 bp, Homo sapiens
gccatacttatgggtttacttgttcttttggacactgcagagtatccattgaatgaacacacaatggcttatctaacactgacttttggatggacgtttargttattcccactcagtcactgttacaaacagtgctgcatcctcctacaaaagtctccgcgtgcttgtttctgtaggacaagtgtctagaagtggatggcc

SEQ ID NO: 84871 - DNA, 201 bp, Homo sapiens
tgaatggctcaattttgccctcgatctggcccactgtcagaactgtgtctgttcagattgtattctatggacagtcctacattcaagctttgctccctacygtgcaaatcttgtttataataatttggcacatagatacctcatgcatcagatgtcgtgtaagattatgccaacataaaacttttacatacaaataaaatt

SEQ ID NO: 84872 - DNA, 201 bp, Homo sapiens
cagtttcaaagatattacaatgggggatggggctgcatttcagaatttatgaaatccgccatttatgttatttgttttcattccctgccccagcttagaayggaagctctatgaggcaacggattttcatgtcttctattctctgctatattttcaaaccctagaacagcaaccgggacagagcagtcaatatctgctgaa

SEQ ID NO: 84873 - DNA, 201 bp, Homo sapiens
catgcgctggcttagcatgtggtttgttatttacagacatcatgtcacggagccctcaaagtggtcctaggaagtttgttcctggactccaggtccgaggycagagggacacttcctctcttgcactcccacaacctttcctgcctgggcctctcagtcttctggaatttttatgtcccccttccccaaccccttacctgg

SEQ ID NO: 84874 - DNA, 201 bp, Homo sapiens
cgaccagcttctgaaaactagaaagcagctgaagtgaccagagcagtttctgaggacagtccaaaagagtgctacaacatccccctggcttgatagctcargacacctgtcctctgaacacagctgctgtaccaggaggaagccctaacaagcccacctggagagatcacctggagaaacctacgtggagagaaaccgagg

SEQ ID NO: 84875 - DNA, 201 bp, Homo sapiens
aatgcaggtcaaaggcttaaaatactgcctggtacatgataagtgctcagtaagtattatcctgctatccttgtaacagctgcttgatacattgttaatayttttactagtaaatttcaatttaataataaatgattcccttcaactgtcttgtcaattccttatcagcagtaacagtcctctgtcccctacaatgcctgc

SEQ ID NO: 84876 - DNA, 201 bp, Homo sapiens
gcaaactttgccagggtttggcacagcctctgaatagttcgcaaactttctgaaaagtccccagtttcatgaaaaattgaccaagtcggcccaggcagcargtctccagccagtgcgcgggctgcaactcccggagcccgtgcgggtagtcgttgcgcgccgcttctgctccccagccctcccccaggcgtcttcacgagt

SEQ ID NO: 84877 - DNA, 201 bp, Homo sapiens
ggttgttgtaaccaatgggttaatgcaggtcaaaggcttaaaatactgcctggtacatgataagtgctcagtaagtattatcctgctatccttgtaacagstgcttgatacattgttaatacttttactagtaaatttcaatttaataataaatgattcccttcaactgtcttgtcaattccttatcagcagtaacagtcc

SEQ ID NO: 84878 - DNA, 201 bp, Homo sapiens
cttccttgctgaagttatttctatctctgcaatcaacgcacccctgggctgcacccttcgcacccccaatacacacacaccagctgggagggaacaggcgrgaacaataaggaaggctgctcagtacacagggactctgtccagtgcctcccttacttgtcacaagtcaggtggggaagatgagggaatatttggttttaa

SEQ ID NO: 84879 - DNA, 201 bp, Homo sapiens
gctcccattttatcgctggagaaactgaagtctggagaggggcagtcacaggggccagggtcatggggttaccatcagtcaaggctgggacttaaacccakgtcatgtgcctccaaaaaccatgctgctgtcaaatactccaccaagggaattcagactccagtgctctctggaacaggcaggtaaagtgaagaccaggtg

SEQ ID NO: 84880 - DNA, 201 bp, Homo sapiens
acagagctctcagcataggtgtttaacaaagaggtaaacagatcattcctgttctcctgaactgagaccctaatcaccccaatcaccacccctacctcctrtttcacagacacagccccagacgggtgcccgcaaagagcgccatgccccattactgaaaactttcagtgatttaccaaggggagagggaagcaatagaaa

SEQ ID NO: 84881 - DNA, 201 bp, Homo sapiens
gtacacacagaccaatactttccaagcatgcccaagcccaaaatctataactcaatactctatgagcttttgttaaatcctaactgtgtgttgcgtgtcargaagcaacgcagcaaaacagtgaagagcacagttttgggagcagataattctgcatccaatttctgcttttcacaatactggtgggcaaagaacattgag

SEQ ID NO: 84882 - DNA, 201 bp, Homo sapiens
aaatgaaaagaactcagggtgttccgagaacaacaagatctgccttctccgagacagcatatgtctggggaaatgaagtgaactgaggcctggtcatttayattttatgcttgcagaaccaaagacactagtgttctttagcagcacgagcaatgccggatttcaacattactaagcaggatgaataggggcagggagaga

SEQ ID NO: 84883 - DNA, 201 bp, Homo sapiens
ggggaccctgggcaagtcacctggcatctgagtctcggttctggaatttgcaaaatgagatgtgacttctggtcctgccttcctcacaaaggggctgtgasagtccagggagatgacgcgagtgatgagtgtttggcacactaggaagtggcggaatatgactatttccgcgccggccccatctgccgctctgctcagcac

SEQ ID NO: 84884 - DNA, 201 bp, Homo sapiens
gaaattaaagagggcacatcacttctgaagccacagacctaaagagataataaaggaatactgtgaccaactccacttccttaaattcaacaacttagatgaaatgaaacagttcctcgaaagataccaaatatcaaaactcaagaagaaacggataacctgaattgtcctatgtctattaaagaaactgaggccaggcac

SEQ ID NO: 84885 - DNA, 201 bp, Homo sapiens
ctgtgatggcgccactgcactccagcctctgggcaatagagcaagactttgtctcaaaaaaaaaaatgcagacatctcattaatacttgtatacacttttmtttttggacccagtcacccttccgtgccatacttatgggtttacttgttcttttggacactgcagagtatccattgaatgaacacacaatggcttatcta

SEQ ID NO: 84886 - DNA, 201 bp, Homo sapiens
aaattaaagagggcacatcacttctgaagccacagacctaaagagataataaaggaatactgtgaccaactccacttccttaaattcaacaacttagatgaaatgaaacagttcctcgaaagataccaaatatcaaaactcaagaagaaacggataacctgaattgtcctatgtctattaaagaaactgaggccaggcacg

SEQ ID NO: 84887 - DNA, 201 bp, Homo sapiens
aattaaagagggcacatcacttctgaagccacagacctaaagagataataaaggaatactgtgaccaactccacttccttaaattcaacaacttagatgaaatgaaacagttcctcgaaagataccaaatatcaaaactcaagaagaaacggataacctgaattgtcctatgtctattaaagaaactgaggccaggcacgg

SEQ ID NO: 84888 - DNA, 201 bp, Homo sapiens
cttgaacttgagaggcggaggttgcagtgagccaagatcatgccactgcactccagcctgggcaacagagggagattctgtctcaaaataaaaataaaatraaataaaactagttagaaatgtttgccaggtcccaatctgagttattgcgcaaaatgcttttgacagtcctgcaaggtagatattattattagagtcttt

SEQ ID NO: 84889 - DNA, 201 bp, Homo sapiens
aagcttcatttccaggaacctccctgtctccgtgggacctggagtgcctggaactccccttcaaagactcacaggctcatatgtgttccctcctcccagcrgcaacaccaaggcaacatcacgctccacaaatgaatgactccacctctcagcaattacggggctggagggcaagttacaggattccctggcctcgttctt

SEQ ID NO: 84890 - DNA, 201 bp, Homo sapiens
tgtcctgggccaggtgtggtggctcatgcctatagtcccagcattttgggaggccaaggtgggaggatcactcaggcccaggagtttgagaccagcctggkcaacataacgagaccccacgtctatttaaaaaaaaaaaaaagagagagagacaaaagagttgtcctgtgtgttgagcacatgaacagtgacagttatgcc

SEQ ID NO: 84891 - DNA, 201 bp, Homo sapiens
taaggtcaccagtgacttctgtgttgccaatccaatggttccttctcaatgataagaggggggtagtcgatggttcaattaacagagttgtcctgggccasgtgtggtggctcatgcctatagtcccagcattttgggaggccaaggtgggaggatcactcaggcccaggagtttgagaccagcctgggcaacataacgag

SEQ ID NO: 84892 - DNA, 201 bp, Homo sapiens
ataaattgcagctatttttatgatgatcttgttgctactagtgaaagatcacgctccagaggcatcagagcaggcacaggccatgtccaaatgggatagckggctgggcacagtggttcacatgtgtaatcccagcactttgagaggccaaggtggcagatcatgaggttaggagttggagatcagcctggccaacatggc

SEQ ID NO: 84893 - DNA, 201 bp, Homo sapiens
gtcaaaggcccacagctgcttccaatcaaggaaagcaaactatccagggcaccacatgctcacacattcccactgctggcccttcaagcacagttccttcrcacacccagtgcagggaaaaaaccacatcctttcaagatccctggcccatcttcctccctttcttctcctctctttgataatgctgttgcatttctcata

SEQ ID NO: 84894 - DNA, 201 bp, Homo sapiens
gagttggagatcagcctggccaacatggcaaagacccatccctactaaaaatacaaaaattagctgggcatggtggtgggcacctgtagtccccactactyggaggctgaggcaggagaattgctcgaacccgggaggtggaggttgcagtgagccgagattgcgccactgcattccagcctgggcaacacagtgagactc

SEQ ID NO: 84895 - DNA, 201 bp, Homo sapiens
ttacatacaaataaaatttgaagtttattttacaaggtttgcattttgacctcgaacacaatcattgaccaacatttgttgaatgcggttgttatattcargatgcaatactacattctcagggtgtaaatggcacaagcaagtgagagagtcaaagcatgtttgtaaaaatacatggactggcacaactcccgttctgtg

SEQ ID NO: 84896 - DNA, 201 bp, Homo sapiens
tcccaacaatttgggaggatgaggtggaaggatcacttgagcctaggagtttgagaccagcctgggcaacatagcaagactccatccctacaaaaaaaaawtttttttaattagctgggcatggtggtgcacacctgtggtcccagccactcaggaggctgaggtgggaggatcacttgagcctaggaggtcgaggctgca

SEQ ID NO: 84897 - DNA, 201 bp, Homo sapiens
tcagtggttaaaagagataaggataatcctcgcatactggcacacaaagatcttaaaggctttatttacaagtaaaaagttggccccccatagtggctcastcctgtaatcccagcactttgggaggctgaggtggtcggatcacctgaggtcaggagttcaagaccagcctgaccaacatggcgaaatcctatctctact

SEQ ID NO: 84898 - DNA, 201 bp, Homo sapiens
tctatacgcactattctggaataaactctcaccatttattgaaggcatcacatccatattcatatccatgtctatagtacagatatatctgtactatatcygtatctatactatagctatctatatctacagccatagctacagctacctcatgtttttcctttatacatccttcattgggaagctctgtaaaacttgtat

SEQ ID NO: 84899 - DNA, 201 bp, Homo sapiens
ataaactctcaccatttattgaaggcatcacatccatattcatatccatgtctatagtacagatatatctgtactatatccgtatctatactatagctatstatatctacagccatagctacagctacctcatgtttttcctttatacatccttcattgggaagctctgtaaaacttgtatttctgttgtatgcctgtacc

SEQ ID NO: 84900 - DNA, 201 bp, Homo sapiens
caactagtctcttgagcctgaactagacagttaacttcccttgaggagatgcaaagcgggtctcggtagtaactcccaatatgactcctgcagcatctcakatcctcgaagggagcaaaaatgaccgtactcagagcaatttccatcaaagatcaactaggagtgttgattctgtcttcacgcagctggatgcgccatggg

SEQ ID NO: 84901 - DNA, 201 bp, Homo sapiens
ccccgcgacgcacatcttctccgcgcctcgggtcccccgccctgggtccttttgtgtgcgctcgcgccaggagaggcgcgccgccccgtgcgcttacctgyggcggaggtcactgtgagcccgaaaaggagccacagccccggctccatgaacctagatcaggcgccggagcaccggaccaggaggacggccgcttgtggc

SEQ ID NO: 84902 - DNA, 201 bp, Homo sapiens
tttctaacgtgcatttttcaattgatgatactgatcaatcaccctccaaaaaaactgcactgtgaggtccctttttttttttttttttttttgagatggaktctggctgtcacccaggctggagtgtagtggcatgatcttggctcattgcaacctccgcctcccaggctcaagcaattctcctggctcagcctcccgagt

SEQ ID NO: 84903 - DNA, 201 bp, Homo sapiens
agagcctcaaggtttgttttttttttttttaatgttttcaacgagctgtgacttgaaacaagaggccagacctgggcagccagcaaactatgatgaataaygctgccaatgagagtgctttttttgttcattaacatcccgcttgtgccctaagaccagggagtgatgtatggcaattgtatcaatgttccccacagggca

SEQ ID NO: 84904 - DNA, 201 bp, Homo sapiens
tgcctggtgcagggtatggctttattcatcacgatctttggaacacgcccccagaatcttgctgactccattcagggacagtcaccaatgaccatcacccycaatttcaatttggggggattttgtctgatccatcctcttttatcctgcctccggattgcatgagctttgttgtggctcttttctgggcacttggggata

SEQ ID NO: 84905 - DNA, 201 bp, Homo sapiens
  misc_feature (1)...(201): n = A,T,C or G, or insertion/deletion polymorphism (see Tables 1-2)
aggtctttggggacatgattaacaaaagctaagatgggaggaaaggacagaaatgagagcctcaaggtttgttttttttttttttaatgttttcaacgagntgtgacttgaaacaagaggccagacctgggcagccagcaaactatgatgaataatgctgccaatgagagtgctttttttgttcattaacatcccgcttgt

SEQ ID NO: 84906 - DNA, 201 bp, Homo sapiens
ggacagatgacacagcagcaagtccacttcaaattgtgtcaaattccacgaagcaagtgaacaaaatgacagtcagaaaataaaccggagcagtggaatarcttgcaaagaaacagccttttggaggagtctcactgaagctgaagtaagacccgggcatgtgaagagatgggacagagaattccaggacaaagaaacagc

SEQ ID NO: 84907 - DNA, 201 bp, Homo sapiens
tgacgtttccatgaattcttgccattaggaattcccaacacccacgctttttcccttctgaaagttctgctgcataaaagaggcagagaacaagccacccsctcctccgcttctctggataattctacaccactcccccctgcccatcaagtgtctgtggaattccagcttcaagccaccccctcctctgcttctctggat

SEQ ID NO: 84908 - DNA, 201 bp, Homo sapiens
aagcccacctccaaaatttcaatgggaaactctaaaacttgccgcaggggcagtaaatgcagataacactttctttgagatcaacaactccagggttccawtcagtatgctggataacttcttttttaggaaattaacacaaaggagaaattgatatttccctctgaaattccaaggatgctcagaaaccctgggaatgtg

SEQ ID NO: 84909 - DNA, 201 bp, Homo sapiens
agataagaaggcatttgcctgagattggacgtcgaatgagttctaggcaccaagggaagcagggaagggagtgatacccaatgcatgaggtgcagacctgmccccaaggaagtttccagcaaccttgctgcaggacaggcaggccataaccccatacagattccccagtagtgttcaaatcacaccacaggcccaacccgt

SEQ ID NO: 84910 - DNA, 201 bp, Homo sapiens
taaagattctgggaatctctcaattatttaaaagtatttaaattatttaattattccttagcaacaggggaagcctagatggaaatgtgtactaacacacygtgatatgttatttaaaatcccaggcagtcctttcctttccctctgtgaccaaatcaagcaacgccagatgctttctgtaggtcatatcttttcatcttc

SEQ ID NO: 84911 - DNA, 201 bp, Homo sapiens
cccctatgaggggaaagattataatccccatttcacagaagaacgaaccaaagctcagagccattaggaaactgctcgtgagtgatgggtgggaaacaaayccaggaccctgactctcaagtccatgccactccactccccatgctgttccatccacacctgggcacatgcacgcctgagcatccccagtggccaagcacg

SEQ ID NO: 84912 - DNA, 201 bp, Homo sapiens
agacttcacaaaacgactttccatgatccttgcttgtacccaggagccatagaccatttggaacttctctgaggacaaactcaggcttaatgatccatttyccttggaaaatggtctcaaggcacacaagagtcaattaaaatcagagtccaccaacttgaatgaaatagccctgggccaccaagacaagtcccaagcctg

SEQ ID NO: 84913 - DNA, 201 bp, Homo sapiens
caggcagcaggtctccagccagtgcgcgggctgcaactcccggagcccgtgcgggtagtcgttgcgcgccgcttctgctccccagccctcccccaggcgtyttcacgagtgcagagcccaggcaagagtttgctccccgcgacgcacatcttctccgcgcctcgggtcccccgccctgggtccttttgtgtgcgctcgcgc

SEQ ID NO: 84914 - DNA, 201 bp, Homo sapiens
gcatccccagtggccaagcacgaggtctcccttaacagtagctcctcctggccccgaaatcattctgcattcttcccagtatccttgcattctcctttacytagtgacactcactaggtgcagatttaagaattcgtcttccttgtgttagattttcccttccatcccataaatctgtttgaatccaaccctctccagcac

SEQ ID NO: 84915 - DNA, 201 bp, Homo sapiens
tgccatgcacatcacagtcctgcggaaaagagaattgccccaagtcccccatactccccaagtaaaacacatgtttagaagtatctgaggccaagtctgawtccgttctgcacaaagtattctgggcatggtttctatccacatgattctcccaggaatgcaactcccattaccatgtaaacaagcgagtattgtactttc

SEQ ID NO: 84916 - DNA, 201 bp, Homo sapiens
catcctaataactgtacaaaaataagctgttattatttttgttacaatgaccacagtgataaaaatatttggggacccaccctccccaaccccgctccacmtgactggttgagtggctggccctagttctgttccatgtttatgcatccagcaaacacttgaatacctcctcggtatcaggcacaatgctgacaggccttg

SEQ ID NO: 84917 - DNA, 201 bp, Homo sapiens
acaggccaaacctggcctactacctgattttgcaaataaagttttattggcacacagctgcacctttgttacgtgtcatccatggctgctttcttgcaacracggcagaattgagaagtggcaagagaggctggcaatatagcccccaaagcctaagatatttgttatctggtcctttatagaacatgtttaacctggaat

SEQ ID NO: 84918 - DNA, 201 bp, Homo sapiens
gagggctggggctttggctttgcacctgtgtgtacccaaaggtcttggacatcaacttaggttgagtagaactttctgagaaaagccagtcaaatgtcacygtcctcattgtccatacaagaaaaccaagaattggcgtttggtgggatcctgccacattacataggaaggtcttaaaagatccacagcagatgtctgttt

SEQ ID NO: 84919 - DNA, 201 bp, Homo sapiens
agtatttatactagagaatgaaaatatatgtccacagaaaggcttgtccgtgaatgttcatagcagctttactcataatagccaataactggaaacaataratagaaatcagcagtttgagatataagatggaatatgacttagtaataataaggaacaaactaccagtataagcagtaacatgaattatgcatgaaacat

SEQ ID NO: 84920 - DNA, 201 bp, Homo sapiens
gatgctggctgagctgaacatgaagttgggctccaaacctaagttgccactcttaaacatcaaaagcagtggttaaaaatagaggaatttatagagtgcargtgattcattgttgttgaggcttgtgggtccacccccccacaaaaaaaaacagctagctttttttccttacatgaaactatttaaacttctgtccccagc

SEQ ID NO: 84921 - DNA, 201 bp, Homo sapiens
gcagtttgttctgacagctcctcttaatgatgtgtttcctgcaagccagctcctcaccaggaactcagaaacacaaaatcaaagcagcccaaccaggcacyggcaaatatctatcaaagccagtgaggctggcagaattctgatacctccttccctgagcttgcctgagaatttgggaaatagtacatgacaataataaag

SEQ ID NO: 84922 - DNA, 201 bp, Homo sapiens
cttttttatagaagatggtcaataaatcattcaaaattagaattgtagatttatgtacatcagtggtactcagctggggatgatttgacccccagggaacrcttaccaatgtctgcaaacatttttgatggtcacaactaatatggagggagtgttgctggctgctgcgatctaaagggtagagcccagggacccggctca

SEQ ID NO: 84923 - DNA, 201 bp, Homo sapiens
gccattggataaacaggttttcagtcttcagccaggctctgaggggctggtccgccatgaaatgtggttcgagctgacatccccgttatgggtcactttargtgtcaacttggctaggatactgtgcccagttgtttagtcaaacagcagcctagatgttgccctgaaggtatttttgatatgtgattaacatttaaatca

SEQ ID NO: 84924 - DNA, 201 bp, Homo sapiens
cacagacattccatgggtatagacccgggatcaggccacaggccaaacctggcctactacctgattttgcaaataaagttttattggcacacagctgcacytttgttacgtgtcatccatggctgctttcttgcaacaacggcagaattgagaagtggcaagagaggctggcaatatagcccccaaagcctaagatatttg

SEQ ID NO: 84925 - DNA, 201 bp, Homo sapiens
tcctctctcactgaacgggtccctgaaggcagttagctgaggacagaggtgatgctttgtcgatacatcatgatctcctgcaactgcctgtgggaactacytgcgccagacacagtctgataaccctcttgttccagatgtattacgacaaaactgaaaacatgggcctctagggagactctaatccagctgagcagatgg

SEQ ID NO: 84926 - DNA, 201 bp, Homo sapiens
attgagtagtgagggtttaggttagtggttctcagccctgactaaatattggcatcacctggggagcacttcgatctaagctgccggggccctgcccccargaatcatacaattgttttagaatcaaaccagtgtccccttgctcaatgtgctgaatctgacttgtgctggcttgggaaagcctaatgttacatttttagg

SEQ ID NO: 84927 - DNA, 201 bp, Homo sapiens
tccccgatgttggaggtggagcttggtgggaggtgttttggtcacgggggtggattccctcatgaatgacttggcgtcctccctgcggtaatgagtcagtyctcactctattaattcacatgagagctgctgtttaaagagcccggcacctcctcccttttctcttgctccctctctcaccatgctacacacctgctcccc

SEQ ID NO: 84928 - DNA, 201 bp, Homo sapiens
gccagctctcagacagcagcacaaccattaacccagctccatgctctgttatcagcagaagtccacgtggggcaggaacttctctaacaagagcattttctatttatttatttatttatttatttatttatttatttatttatttattttgagacagagtctcactctgtttcccaggctggagtggagtggcgcaatctc

SEQ ID NO: 84929 - DNA, 201 bp, Homo sapiens
tgccagctctcagacagcagcacaaccattaacccagctccatgctctgttatcagcagaagtccacgtggggcaggaacttctctaacaagagcattttytatttatttatttatttatttatttatttatttatttatttatttattttgagacagagtctcactctgtttcccaggctggagtggagtggcgcaatct

SEQ ID NO: 84930 - DNA, 201 bp, Homo sapiens
ccagctctcagacagcagcacaaccattaacccagctccatgctctgttatcagcagaagtccacgtggggcaggaacttctctaacaagagcattttctwtttatttatttatttatttatttatttatttatttatttatttattttgagacagagtctcactctgtttcccaggctggagtggagtggcgcaatctca

SEQ ID NO: 84931 - DNA, 201 bp, Homo sapiens
cagctctcagacagcagcacaaccattaacccagctccatgctctgttatcagcagaagtccacgtggggcaggaacttctctaacaagagcattttctatttatttatttatttatttatttatttatttatttatttatttattttgagacagagtctcactctgtttcccaggctggagtggagtggcgcaatctcag

SEQ ID NO: 84932 - DNA, 201 bp, Homo sapiens
gctgtggctcgggcttttctggcttctgcaccacccccgtcgcctccccgccccccagaggggctggaactgcctcgccgggcctttgaacccgggcgcaytgggggtcgcctcccaggcgctggggggagctggccaggagcgcagcggcccgaggcgcacccaggacagcgaggggcgggggcggcgtggcgtggcgcg

SEQ ID NO: 84933 - DNA, 201 bp, Homo sapiens
ctctcagacagcagcacaaccattaacccagctccatgctctgttatcagcagaagtccacgtggggcaggaacttctctaacaagagcattttctatttatttatttatttatttatttatttatttatttatttatttattttgagacagagtctcactctgtttcccaggctggagtggagtggcgcaatctcagctt

SEQ ID NO: 84934 - DNA, 201 bp, Homo sapiens
gagaagagggaaaacagggagcaagtattttcataaggatggggttatgtgcaaagggattaaaaaaaatgccgacaccatgatacatgctttgaataatytaaagaaagcaagagaagacactcttgctaattttcaggagataccaggttaaggatggaaaagatcttcatgagcaagacttatgcttaccatcacaat

SEQ ID NO: 84935 - DNA, 201 bp, Homo sapiens
atgtacacacacatttatacttatatatatgcacatacatatatgtacatatatgtgtgtgtatatatatacacacatacatatacgtatatgcgcgcgcrcacacacacacacacacacacacactcaaaaattagccaggcgtggtggtgcaggcctgtagtcctagctacttgaaaagctgagtggggaggatcacct

SEQ ID NO: 84936 - DNA, 201 bp, Homo sapiens
agaatacattaaaatacaagtttaaatgttttgttaatgcttttttttttttttttttttttttactctttatgcatttaggggagaaaaaaactcaaaaraaatggcattcctgctggattaagtttagtgtggcttgatccagggcagcctgggaagccggcctgggcatcttgataggagctgatcagactgttggga

SEQ ID NO: 84937 - DNA, 201 bp, Homo sapiens
gccaggcgtggtggtgcaggcctgtagtcctagctacttgaaaagctgagtggggaggatcacctgagtccagggaggcagaggctgcagtgagcagtgaytgtgctgttgcactccagccagagtgacagagcaagactctgtctcaatttaaaaaaaaaaaaaaaaaaaagtgaaagccacatgatgatctgcccaatt

SEQ ID NO: 84938 - DNA, 201 bp, Homo sapiens
cctgtgcatccccaacagaaaagtcctcgtaggactgacctttccaacaaactgcgaaacttagccctaagtctccccaattttaaagaagtatcttgccrtccagtgttctaagaaatatgccactccaactcaaaactggtacccaaaagtgtgctaatttctaaggaagagatagaaatggttatgtgaggggaaaaa

SEQ ID NO: 84939 - DNA, 201 bp, Homo sapiens
ggggaggatcacctgagtccagggaggcagaggctgcagtgagcagtgattgtgctgttgcactccagccagagtgacagagcaagactctgtctcaattwaaaaaaaaaaaaaaaaaaaagtgaaagccacatgatgatctgcccaattcattgagcaacctggagacgccatggacttcatgctttcaacctcctgtat

SEQ ID NO: 84940 - DNA, 201 bp, Homo sapiens
tcaggctgcttatcagcaacagcagacagccaggcacaccttttcccagagtctgtaagctttctgctaattgaggctaacagaccgtcctgcaggggacagggtggacaggtttgctccggggcactccaggagctaagatcagagtcagaaggtccaaagaggtggaccccagcagaacttgagcaaggactttctact

SEQ ID NO: 84941 - DNA, 201 bp, Homo sapiens
acccagccttatctttctcagaacttaccactataatatgaattgttcatggtcatgatcctaccttcacatatcaactccatgaaggcaatatttttttkcctgttttcttttcttttctttttattttttatttttttgacagagtcttgctctgacacctaggctggaatgcagtggcgcagtctcggctaactgcaa

SEQ ID NO: 84942 - DNA, 201 bp, Homo sapiens
ctttgggacctcaaagatgtcccttcacctctgtatcccagaactctcatctgtaaaatgggttaataccagtatctgctccttaggttgtacctacctayaatggacctacaataacgtgggactccagtgaggctcaaagtgagcacaaggtgagtcttgcaacttgcatcagtgcaggacacacgtcctattgaagtc

SEQ ID NO: 84943 - DNA, 201 bp, Homo sapiens
tttcagtcttcagccaggctctgaggggctggtccgccatgaaatgtggttcgagctgacatccccgttatgggtcactttaggtgtcaacttggctaggmtactgtgcccagttgtttagtcaaacagcagcctagatgttgccctgaaggtatttttgatatgtgattaacatttaaatcagtagactttgagcaaagc

SEQ ID NO: 84944 - DNA, 201 bp, Homo sapiens
gacagagtcttgctctgacacctaggctggaatgcagtggcgcagtctcggctaactgcaacctccacctcccaggctcaagtgagtctcgtgcctcagcytcccaagcagctgggattacaggcgtgcaccaccatgcccagctaatttttgtatttttagtagaggtggggtttcatcatgttggccagactggtctcg

SEQ ID NO: 84945 - DNA, 201 bp, Homo sapiens
gaaggtaccgacgccattcaatatttatgaagcaacattccccaagaatatcaggccaggaaggcaactgtagaaacatcacccagtgaatatgaaaaccrtttgctcggggttttttttccccctagtgtttcggcaaagaaaaggacttagttctctcctcccctctccccacggcaaacacacaaacacactgatttg

SEQ ID NO: 84946 - DNA, 201 bp, Homo sapiens
gaggagtaggagctggataggtcctgctttttgagagactacgaataactattctttggggagttcctacgatgtgccaaattctggactgggctctttamatagtttatctcatttctatgatcacaactactctccccatcttccagatgaagaaactaattctcaaaggaaaaatggcttcttcaaggttactcagat

SEQ ID NO: 84947 - DNA, 201 bp, Homo sapiens
ggggaaaagaaatcaaggaagccatctggaggaggtgacccttgaggtaagttttgaaggaggagtaggagctggataggtcctgctttttgagagactaygaataactattctttggggagttcctacgatgtgccaaattctggactgggctctttacatagtttatctcatttctatgatcacaactactctccccat

SEQ ID NO: 84948 - DNA, 201 bp, Homo sapiens
tgccatgcagatgctgagaaggaatgagattctgcatttccgacaagctccagggtgaagctgatgctgctggtctatgtaccacattttgagtaggaagracacaagggagctaactcacatggattagcttacttaatcctcacaaccatgctctaattataggctattatccccattttatagataaggaagctgaga

SEQ ID NO: 84949 - DNA, 201 bp, Homo sapiens
ttgcagaagtgttcaccatagggtttctttaaatgacggactcccttaagtacatttaaaaaataagatctaagttgccaaaggctatttattcacaaatrttaacagatgtatgaagtgatcctgactgtttcagtgtttgggtgggtggggagtggatgaaatcttaatactccagacagaagtcagagcttctcaaag

SEQ ID NO: 84950 - DNA, 201 bp, Homo sapiens
tttaagaattcgtcttccttgtgttagattttcccttccatcccataaatctgtttgaatccaaccctctccagcactttcccagaccaggaagtgcctcmgagcacacggggaaccccatcacaccccaatacggatccctggagccccagatccactgagtggggacctcaaggtgagcccaggaatctgcattttaac

SEQ ID NO: 84951 - DNA, 201 bp, Homo sapiens
aatatagcgagatcccatctttaaaagataaagaagttctgccaagttgtatactgtaaatcttaattgaaatttgtcaaggtttgcccatccctgggatmgtgaaactggggaaaagtggtgggaatgatcctataacccttgtgttctaaccaacagttactaagcccaatatttccctcactttaggtaagaatttac

SEQ ID NO: 84952 - DNA, 201 bp, Homo sapiens
tccattaaattgccaagtttgatcgtcaaattttcctttttttaatatgctcaaataaacatatcactatttaaaaagttttaagtgttgtctctaaaatygtgtgcactgattgtacccacaccacactttacaattatttcccataccacacctggacttcatgaccctacatcctacactaacagcctcaggtacctt

SEQ ID NO: 84953 - DNA, 201 bp, Homo sapiens
aaccatgggtttgctgtgtgccctaagcaccttacttgggtgatgtcactgaattctcaatataatcctatatgatcaaggccaacattaccattgacagsctggacctctgataggctaatgagaagcacacttcccttctgacatcttcctccccaaaatcaataagctcagtctaatacgaggaaaacatcttgcaaa

SEQ ID NO: 84954 - DNA, 201 bp, Homo sapiens
ctctgccccagcaggtgcacatacactggcgtttgggaaccactgagtcctttacctcattggtgctacgcaggaatcacctggagttcttactgaaatgragattctggttcagcagggctggggctgggcctgggcctgaaattctgttgatgcagcagattccggggccacacattgagtagtgagggtttaggttag

SEQ ID NO: 84955 - DNA, 201 bp, Homo sapiens
tccccagccagtgctccggggtttggtaaacaggcaacgaatgaaagagatggtttccaaatcctctcccacctgcccaccaccccaggttcctgtctgtmattccattagctttcttctttctccttctagattcacagctggggattctggccaagacaagaactcggttcctggtgactgcccagtgccctccattct

SEQ ID NO: 84956 - DNA, 201 bp, Homo sapiens
ccacctcaaaaacaaacaaacaaacaaacaaacaaacaaacaactgtcaacgtcatcaagaccaagacaagtctgagaaaattgtcacagatcaaaaaggyctaagaagaaaactaaatgtaaggtggtgtcctggatgggaccctggaccagagagggacattaggaaaaaatgagtgcagtttgaattagccatggagt

SEQ ID NO: 84957 - DNA, 201 bp, Homo sapiens
  misc_feature (1)...(201): n = A,T,C or G, or insertion/deletion polymorphism (see Tables 1-2)
acagtgacagcaggactttaagccgagccagagtctttctgagtgcaggactttgtgcacgtgtcctgctggctcaatgtgaagcccctgcctgcccttcnagcatggtggggtgatgttccagatctatcatggatgtgattagaggtcttgtcccctggtctgaaagacattccacccctcaggtttactaccctcgtc

SEQ ID NO: 84958 - DNA, 201 bp, Homo sapiens
tttgcatactttctgcaaactttgccagggtttggcacagcctctgaatagttcgcaaactttctgaaaagtccccagtttcatgaaaaattgaccaagtyggcccaggcagcaggtctccagccagtgcgcgggctgcaactcccggagcccgtgcgggtagtcgttgcgcgccgcttctgctccccagccctcccccag

SEQ ID NO: 84959 - DNA, 201 bp, Homo sapiens
taggatttcaacagataaatctggagaggacaaatattcagaccataataattactatctctttggaattaaaatttccatcttcaacaaaataaaaagtycttggattgggggatggctggaggaatagaaaatatactaatcagctaaaaggagaaaaggagtaggaggaggtttccgggtaccatgttcagacacagg

SEQ ID NO: 84960 - DNA, 201 bp, Homo sapiens
tttttgaacaaagggatacaaaaggaatgtagcaggccataggcttgtacaaagggatagcaggccataggcttggagcctttgtcaggctgtggaatcgrgcttactgtgcatggtagtgattgacataaaattcctttctaaattaatacacttaagtcaagtaaaggtaacctcaattacaatatgaagtaattcatt

SEQ ID NO: 84961 - DNA, 201 bp, Homo sapiens
tggaatctcttgcattttggtatttgttttatttcagcaatgcctctaactcatacctttcccatccctcccaggagccctgacccagaccgcatgcacgmacacacacacacacacacacacacacacacacagtctcaacttatctcaaacaacatgtgtgtactttaactggagccttcaatgcctcagccaaagttg

SEQ ID NO: 84962 - DNA, 201 bp, Homo sapiens
ggggacactgaaggtctcagaggtgacatctcctaagtggcagatccagatttcagcccaggcattcgagcccacagtttgagctcttaacccctacaaarggatctgttcctcctccacgtgacaatttggatgagtgggccccaggccccattcctctctaaaccccaggagtctctaaaccaaagtgtgaagctggat

SEQ ID NO: 84963 - DNA, 201 bp, Homo sapiens
catgcacgcacacacacacacacacacacacacacacacacagtctcaacttatctcaaacaacatgtgtgtactttaactggagccttcaatgcctcagmcaaagttgggaatttcaagcatctcagcagatacatgggagagatgcttttgaataagttaagtcaacatgccacaaacacacctgtgtgttttaattac

SEQ ID NO: 84964 - DNA, 201 bp, Homo sapiens
ccagatcaaatgctgccccttctagcaacctgatttgcctgtttaaaaaaataatatgttgagatcctcctgtagctgctcaaacatttagacttgcaggmaagcataatggcctcactcatgggctttgaagtcaaacagacctggatcaaaatactgacatcccccttgcctagctgtgtgaccttgggcaagtcactg

SEQ ID NO: 84965 - DNA, 201 bp, Homo sapiens
ggattaattcatgccagacgctaaagtcaggcatatgatggcagttaagcccacaaaagatgagtgactgccgctccagcctgagcaatagagtgagaacmtgtctcacaaaaataaaaatacatataatgaaagcacagaactccatcattaacattctaacaagatatgactgtgggctgtggagttcctggctggcct

SEQ ID NO: 84966 - DNA, 201 bp, Homo sapiens
tatgactgtgggctgtggagttcctggctggccttctctttctgtgttggggaggtgttaaaaatatgctttcatcaaagggaggctgtcctggggcagtmgggattggaacagaaggaggcagcagccttgtcattatgcgatttagtatcagtgtcatgtccatgcaccttataacattatctcaggctccactcttga

SEQ ID NO: 84967 - DNA, 201 bp, Homo sapiens
ccttctctagaggagaaagcaggaatcccctgccttggggatctgtgtgcctgtcaccacctgaagccaacttaacaagggcaccaccttgggagcagagrctgggagcatgcaggtgggatcaaaggaccctatggcaatgctgcctcatgttatgaggctttctccggccacccctcccctccattgcctctgggtctt

SEQ ID NO: 84968 - DNA, 201 bp, Homo sapiens
tcctaagagatttcaatggaaaagcatgaggacatgattcataggagttctgaggagacacgctgaccatgttgttggcttggttggaggcttgtcctttwaaaagcacctatttcttgtaaaaaatgaaggaggtttttcctcgttctgcacagccagccactcagtggccgcgggacttccatggccatacgttgggcc

SEQ ID NO: 84969 - DNA, 201 bp, Homo sapiens
agctcaacccaatcataactgaaatgcctgtgtctctgcaaatttgtatgtgtaagatctgggtttataaaggcatgaaagggcttaacaagctgtttaargagttgaaagcagctcaacctgtctggaacatggcatttgagggaggaagtaaggaggataaggggagaaaggcaactagggagattggcaaagacaatc

SEQ ID NO: 84970 - DNA, 201 bp, Homo sapiens
tgggaggccaaggtaggtggatcacttgaggtcaggagttcgagatcagcctgaacaacatggtgaaaccccatctctaataaaaatacaaaaattcaccrggcatgatagcccatgcctgtaatcctagttacgtcaggaggctaaggcaggagaatcgcttgtacctgggaagcggaggtttcaatgagccgagatcat

SEQ ID NO: 84971 - DNA, 201 bp, Homo sapiens
gtgcacggcttggtcattgtgtttatttttcctcaactttttccaagtcagcagatgtgcgactgatactttgagtccttaccacttacattttgattcayaacccagccattaagaatgttgcaatttatctcagataagcatcccctcaagttgtctctttatgtgctttatgattctttgaagattgtttttccttta

SEQ ID NO: 84972 - DNA, 201 bp, Homo sapiens
gcacacaagagtcaattaaaatcagagtccaccaacttgaatgaaatagccctgggccaccaagacaagtcccaagcctggctcctaccccaggcagagcragcagtagcctcgggagaaaagcaattatttagggttgcagcaaggacgtgtgctactatcgaggagcctctaagttccctccccatcccagcagcctct

SEQ ID NO: 84973 - DNA, 201 bp, Homo sapiens
tgtttgataaggccagcattactctaataagaaaccagacaaagacattgtaagaatacagaccaaaaaaacaaaacaaaaacaaacaaaaaaaaaccccmaaaaaacccaacattattctctcagcacggcgtgttctctcagcattccttgtggctggggcctcatcacgtgacacagactccaccaatcagatagcac

SEQ ID NO: 84974 - DNA, 201 bp, Homo sapiens
ccttccacatcattaatacctgtcacacacagcgatgaacatgcagggctggtgggtgtgactgataggggaagaggtgaggggaaggtgctgactcgccrggacttgaaccctttctagttctatcacttactgctggggtgaccctgggcaaatagctttctctctaagcctcagtcttctctgtttcaaacaggggtg

SEQ ID NO: 84975 - DNA, 201 bp, Homo sapiens
ctgctcatggtaattgtctccagaaccagcagcagaatggctatgttggttcattggtcagggaatgagaagagctactgaaataaatgcttagtttttttctagaaagtctgaaatttcacagttctagcaggcaagacataagtgctcgttcaaaaccatctctggtgggagtagaaaccatgcagggaagagagaaag

SEQ ID NO: 84976 - DNA, 201 bp, Homo sapiens
ttctccctagcctcataccctcaaaagaggaccttgaaatcccccctccaaacagccactgcccctgtgccaattgcaggggaaggatgtggagggtgaargccaatgctgagcagacccagctatcatttctagaaccatcctctgcttttcaaaatgtcaagtctgttctactggaatagagtcacagccttttccatt

SEQ ID NO: 84977 - DNA, 201 bp, Homo sapiens
gccttggggatctgtgtgcctgtcaccacctgaagccaacttaacaagggcaccaccttgggagcagaggctgggagcatgcaggtgggatcaaaggaccytatggcaatgctgcctcatgttatgaggctttctccggccacccctcccctccattgcctctgggtctttgttcagaagcaaggcacaccacctgtaagg

SEQ ID NO: 84978 - DNA, 201 bp, Homo sapiens
gagccatcactctctgaaagactctgtccctttgtttactgggcttttcatccccagccagaaattgccacagttcttcgctttctggttttctacacacyccagttgccaacagctatagccctaactccaagcaggaagtgaccgctggaaagcagctgaacaaagcaaaggtgatcaaggtcactggatgggagatga

SEQ ID NO: 84979 - DNA, 201 bp, Homo sapiens
tgcagtggtgctatcacagttcactataacctcagactcctgggctcaagcgatcctctcacctcagtcccagagtagctgggactacaggcatgcaccamcacacttgctcattttttaattttaattttgtagacctgggatcttactatgttgcccaggctagtatcatgctatcctcctacctcagcctctcaaagt

SEQ ID NO: 84980 - DNA, 201 bp, Homo sapiens
tgagaaaagccagtcaaatgtcactgtcctcattgtccatacaagaaaaccaagaattggcgtttggtgggatcctgccacattacataggaaggtcttaraagatccacagcagatgtctgtttgggccacattgctcccctgagaatctcctcccttcttgtggttcactttccccgctgcgtgctgagccatcactct

SEQ ID NO: 84981 - DNA, 201 bp, Homo sapiens
tacataggaaggtcttaaaagatccacagcagatgtctgtttgggccacattgctcccctgagaatctcctcccttcttgtggttcactttccccgctgcrtgctgagccatcactctctgaaagactctgtccctttgtttactgggcttttcatccccagccagaaattgccacagttcttcgctttctggttttctac

SEQ ID NO: 84982 - DNA, 201 bp, Homo sapiens
cagatcatttgccatttctcctttttaaaaggtctttggggacatgattaacaaaagctaagatgggaggaaaggacagaaatgagagcctcaaggtttgttttttttttttttaatgttttcaacgagctgtgacttgaaacaagaggccagacctgggcagccagcaaactatgatgaataatgctgccaatgagagtg

SEQ ID NO: 84983 - DNA, 201 bp, Homo sapiens
gccaggaaggaaatctttctcctccatcttgggtcgttaaccagctgtgtgtgttcaactcgacactcagcaggagcccatctgggcaatagtatcactgyatgttcttttctaactcaaacaatattatgcaagcttgagtagaggtctctagggtcacgcatggcattaggacgatggatggatttgggttttactact

SEQ ID NO: 84984 - DNA, 201 bp, Homo sapiens
tcagtctagcgctcatcattcaagtctgtccaaaaacctcctcctccaagaagtccttcttgactctttcactatggatctcatctttccttcaaaaatattttttttcaagattttctaaaaaccgttgtacaagtgtcaagatctctgtgtataacaatgaacaagacacatccctgcccaggaggtgctttctgaaaa

SEQ ID NO: 84985 - DNA, 201 bp, Homo sapiens
aggagaaattgatatttccctctgaaattccaaggatgctcagaaaccctgggaatgtgctatctgctatacaggaggcttggcccccaggaacagggacrccggccctgcctaacccacactctccacctgagatctctctgctcccttcctctctcactgaacgggtccctgaaggcagttagctgaggacagaggtga

SEQ ID NO: 84986 - DNA, 201 bp, Homo sapiens
caagccagagacaggagcaggcccgcaggtagcagcagaagtgggcaaccatgtagccccctggaaagacagataacaggctctgctgaccttcattcctsagatggagcacctgattcctaggagtgtcccttggtcccattcaaccaaacaatctctccaagcacttcaaaatacccttcaggcgtgagaaggtgggaa

SEQ ID NO: 84987 - DNA, 201 bp, Homo sapiens
ttcagtggttaaaagagataaggataatcctcgcatactggcacacaaagatcttaaaggctttatttacaagtaaaaagttggccccccatagtggctcwctcctgtaatcccagcactttgggaggctgaggtggtcggatcacctgaggtcaggagttcaagaccagcctgaccaacatggcgaaatcctatctctac

SEQ ID NO: 84988 - DNA, 201 bp, Homo sapiens
aggctaagcaggtgaagcttgcctgctgagtagtacacatgagttagaagtcaggagttgccaaggtgaaaacctagcaacacatcgggttttaacaacayaaggcttgaaaaatatgaagaaacaggcaagatatataacaagaccatgtatgtacataaaaaatacatgcccataatttatttatggtgatagacgtca

SEQ ID NO: 84989 - DNA, 201 bp, Homo sapiens
gttgcagccatcagaactgactccgacttgcttaagcattgaaggaatggatcagcaggacatcaatgagctcacagaactgacaaaaatgttcgtgcatyggactcagaaagcaagccagttccagggaagctgagtcgccacagagaccacgaatctgggccccgcagccggctcttctgctgtacactcagaactcca

SEQ ID NO: 84990 - DNA, 201 bp, Homo sapiens
tgcagacagacagggctcaaaatagttcccagcagtggaaagagaagagggaaaacagggagcaagtattttcataaggatggggttatgtgcaaagggattaaaaaaaatgccgacaccatgatacatgctttgaataatctaaagaaagcaagagaagacactcttgctaattttcaggagataccaggttaaggatgg

SEQ ID NO: 84991 - DNA, 201 bp, Homo sapiens
aaatcattaatacacttaagatttatgtacttacaaagtaaaaaaaacaaaaataaagctccacaggtgattctgatgccccaccaacactggaaaaagcracctattttacccacaccaaaaaaaaatttattattcttaatattgctaattaagagctaaagcttccaacagctcaatctgctttgttctgaaatcata

SEQ ID NO: 84992 - DNA, 201 bp, Homo sapiens
aaaaaaaaaaacatggccaaaatccaccaaaaccaagatggcaacccaagtgaccttctgttgtcctcactgctcattatatgctaattataatgcattasccactaaaagacactcccaccagcgccatgacagtttacaaatgccatggcaacatcaggaagtcaccctatatggtctaggaagggggaacctcagttc

SEQ ID NO: 84993 - DNA, 201 bp, Homo sapiens
gcttgaccacaaagaggcagcaggagggaatttgggggatggtgaaaacactctgcaccttggtgatggttgcacaatgggatgttcaccaaagatcccaygaccaaaagctaaaaagcctgaaattaaccatatgtaaagtagatcttaaacaaaatgggacgaaacagcaaatctgtggactgggtccaagctgtgggc

SEQ ID NO: 84994 - DNA, 201 bp, Homo sapiens
ccctgcaagagacccatggaaatcagattcctaaaaatccagaaaagttacatggacctctgctgtctcatgtagttgcttctgactctcggcaaagcaattttgcgctccccaagttgtggggcgaaactgtccaccagcgggccagtcatgtttttggttgcgtctgtcggtacttttgtcatcaatgcatatgaaatg

SEQ ID NO: 84995 - DNA, 201 bp, Homo sapiens
ggcacatagcaggcactccataaatgtctgaataaatcaatgaatgcccctgcagtaaatactgataaagcctaggggaatgggggaagtagctggcacargtaaggtgaatgtgtgcatctctgccagctctcagacagcagcacaaccattaacccagctccatgctctgttatcagcagaagtccacgtggggcagga

SEQ ID NO: 84996 - DNA, 201 bp, Homo sapiens
gaaaaagccccagatacccctggcgtcctggggagggtgtgtaggactggactcatctggaaagagagactctcatgtctccttttactatcaaaacacaygcacagaccaaaatgcacagatgcatgggacatactgggctgaaataaagattctgggaatctctcaattatttaaaagtatttaaattatttaattatt

SEQ ID NO: 84997 - DNA, 201 bp, Homo sapiens
ctcttgttcaactctgggagaggaggagagggatgttgttggtcagacccaggtgggcctgagattgagatgagtaggcttgggccctgggcattcccacrgtctggggaaatcaagccagagacaggagcaggcccgcaggtagcagcagaagtgggcaaccatgtagccccctggaaagacagataacaggctctgctg

SEQ ID NO: 84998 - DNA, 201 bp, Homo sapiens
aaatatatgtgaaattgattttcaacaaggatgccaacccattcaatagaggaaaagacaatcttttcaacaaatggtcctggaaaaacaggatatccacrttcaaaagaataaaagtggacccttagctaacaccacatacaaaaattagctcaaaattgaccaaagacctaaatgtaggagctacaattctgaaactct

SEQ ID NO: 84999 - DNA, 201 bp, Homo sapiens
gcagacagacagggctcaaaatagttcccagcagtggaaagagaagagggaaaacagggagcaagtattttcataaggatggggttatgtgcaaagggatwaaaaaaaatgccgacaccatgatacatgctttgaataatctaaagaaagcaagagaagacactcttgctaattttcaggagataccaggttaaggatgga

SEQ ID NO: 85000 - DNA, 201 bp, Homo sapiens
gttcccagcagtggaaagagaagagggaaaacagggagcaagtattttcataaggatggggttatgtgcaaagggattaaaaaaaatgccgacaccatgawacatgctttgaataatctaaagaaagcaagagaagacactcttgctaattttcaggagataccaggttaaggatggaaaagatcttcatgagcaagactt

SEQ ID NO: 85001 - DNA, 201 bp, Homo sapiens
ctaaagaaagcaagagaagacactcttgctaattttcaggagataccaggttaaggatggaaaagatcttcatgagcaagacttatgcttaccatcacaaygaccgtaaagatacgctcatcttccacctaacctaattgtctgtgtccttgtgtaatgcccttttggtagctctgtcagaggtgttcgaaccagagcaac

SEQ ID NO: 85002 - DNA, 201 bp, Homo sapiens
ccccatgagctggctctcatctctgaggttctcataaaaaaggtcccacctcccctgtccagtcccagcttattcacagtcccagtgaatgctggactcakggaaagggaatatgaaccaagcatatttgacttggatttgccactaacaaacaagagtcctgagtgctctgcgaacaaagggtaagtcctccatgatgtc

SEQ ID NO: 85003 - DNA, 201 bp, Homo sapiens
aagggtaaatatatgattacatagaattatatatatgaatcatcactatcaaaaagaacaaaaccccagccctaacaatgtaacaagacccgatctctacaaaaaaaaaaaaaaattactaaattagctaggcatggtgacacgcacctgtggttccagctactcgggaggctgaggtgggagattcgattgagcccagga

SEQ ID NO: 85004 - DNA, 201 bp, Homo sapiens
gagcctgggaggtggagattgcagcgaactgagatcgcaccactgccctccagcctgagcaatgatagtaacaaccaccaagttaagatggtaaatttgaygttacatgtattttactacattaaaaaaatacaaataaaaaacacacttgctaagtaaagaagccagtcacaaagactacgattccatttatgtgagatg

SEQ ID NO: 85005 - DNA, 201 bp, Homo sapiens
ctacaaaaatgcaaatatctgggccgggcacagtggctcacacctgtaatcccaacaatttgggaggatgaggtggaaggatcacttgagcctaggagttygagaccagcctgggcaacatagcaagactccatccctacaaaaaaaaaatttttttaattagctgggcatggtggtgcacacctgtggtcccagccactc

SEQ ID NO: 85006 - DNA, 201 bp, Homo sapiens
gactggccctctgcctcatatggccacatgtccaacaatgatactgccaggtgtggctcacaggtcagggtgacttttgtttttttgagatggaatcttgstctgtcacccaggctggagtgcagtggcgtgatctctgctcactgcaacctccacctcctgggttcaagtgattctcctgcttcagcctctccagtagct

SEQ ID NO: 85007 - DNA, 201 bp, Homo sapiens
ggagtaggaggaggtttccgggtaccatgttcagacacaggaggtatcatggctgcttagaccactctctgggtctatggccttcagtagcttgaagccgacaccaccacttgtcttcactgggactaaaaatcaacaaaccctggatgagcctctcaggcaccaggaggtgctagccaaataccaggatggagctggccc

SEQ ID NO: 85008 - DNA, 201 bp, Homo sapiens
aaggagacagccttagttaaggtcaccagtgacttctgtgttgccaatccaatggttccttctcaatgataagaggggggtagtcgatggttcaattaacrgagttgtcctgggccaggtgtggtggctcatgcctatagtcccagcattttgggaggccaaggtgggaggatcactcaggcccaggagtttgagaccagc

SEQ ID NO: 85009 - DNA, 201 bp, Homo sapiens
taagctgctttgtgtcaggaaggatgagcagcccctcacaggaaggaccagtgaacacacttgaccttcttgtggctcactagtgtcatcctgcagcacgyctaagaggaagtggcaggcgccatgcatcagatagaaggctgggaggagcattctatatccagaatgtggccacaccacccttgtctgggaggtactgaa

SEQ ID NO: 85010 - DNA, 201 bp, Homo sapiens
gagtaggaggaggtttccgggtaccatgttcagacacaggaggtatcatggctgcttagaccactctctgggtctatggccttcagtagcttgaagccgacaccaccacttgtcttcactgggactaaaaatcaacaaaccctggatgagcctctcaggcaccaggaggtgctagccaaataccaggatggagctggccct

SEQ ID NO: 85011 - DNA, 201 bp, Homo sapiens
agaggcaataaacaggtaaataacatggtagaacaaaactacagactctgaaagtttccataaagggattggacagggtgaggccacatcgagtaactagsgggggccgtttacaatgggtggtctgtgaaggcctcaaaggtggttgaggtttgagcaggtcccaaggatgggagggagccaggcatttacatccctgag

SEQ ID NO: 85012 - DNA, 201 bp, Homo sapiens
tggcgtcctggggagggtgtgtaggactggactcatctggaaagagagactctcatgtctccttttactatcaaaacacacgcacagaccaaaatgcacaratgcatgggacatactgggctgaaataaagattctgggaatctctcaattatttaaaagtatttaaattatttaattattccttagcaacaggggaagcc

SEQ ID NO: 85013 - DNA, 201 bp, Homo sapiens
acccttagactccctggagaccaggatgctttcaaggaattttaaaccccttggatcctggtggggtcaacagtgagtatgagcccccttggcccctgggraatgagataaactttcggggctttctctatctcagaaaagaggctcagagagacatctcaggtatctaatccccctggtcagttcacttcattcagaggg

SEQ ID NO: 85014 - DNA, 201 bp, Homo sapiens
ggggtggagcaagcaaaatgtctgcaaagtttccaaagctctgcgcagtttctgaaaagtttccaagctatctgcacactctgtgaaaagcttgcaagctrtctgcacccgttgaaaacttgcatgcattttgcatactttctgcaaactttgccagggtttggcacagcctctgaatagttcgcaaactttctgaaaagt

SEQ ID NO: 85015 - DNA, 201 bp, Homo sapiens
gaaaaacagtatggcagctcctcagaagactaaaaatagaataatgacagccgggcagggtggctcatgcctgtaatcccagcactttgggaggccaagaygggcagatcacgaggtcaggagttcagatcagtctggccaacatagtgaaaccctgtctttactaaaaatataaaaaaatagctgagtgtggtggtgcgt

SEQ ID NO: 85016 - DNA, 201 bp, Homo sapiens
aaggagccacagccccggctccatgaacctagatcaggcgccggagcaccggaccaggaggacggccgcttgtggccgcgaaagggcactggggccgggtwcagctggcctcgccctccagctgtgggggttcgaggccggccgatcgctcgctgcgtctccagctccggccaggagttggctgcggcggtcataaacttt

SEQ ID NO: 85017 - DNA, 201 bp, Homo sapiens
actgtcaatgtaggccgggcacagtggctcacatctgaatcccagcactttgggaggccaaggcaggtagatgacttgaggtcaggagtttgagaccagcytggccaccatggagaaaccctgtctctactaaaaatacaaaaattagccaggcgtggtggcaggtgtccgtaatgccagttactcgggaggctgagccag

SEQ ID NO: 85018 - DNA, 201 bp, Homo sapiens
taaaactagttggtggagacggataatattaccattcttgacccagcatagctggcagggttctaagttgcagccatcagaactgactccgacttgcttargcattgaaggaatggatcagcaggacatcaatgagctcacagaactgacaaaaatgttcgtgcattggactcagaaagcaagccagttccagggaagctg

SEQ ID NO: 85019 - DNA, 201 bp, Homo sapiens
gccggccgatcgctcgctgcgtctccagctccggccaggagttggctgcggcggtcataaactttcagagcgcgctgcccatccctgcgcggagctggccrgctgtggctcgggcttttctggcttctgcaccacccccgtcgcctccccgccccccagaggggctggaactgcctcgccgggcctttgaacccgggcgca

SEQ ID NO: 85020 - DNA, 201 bp, Homo sapiens
ttggacccagtcacccttccgtgccatacttatgggtttacttgttcttttggacactgcagagtatccattgaatgaacacacaatggcttatctaacaytgacttttggatggacgtttaggttattcccactcagtcactgttacaaacagtgctgcatcctcctacaaaagtctccgcgtgcttgtttctgtaggac

SEQ ID NO: 85021 - DNA, 201 bp, Homo sapiens
ataaggaagctgagacagagaatggctaagtcactcagctaaggtgggatttgaattcaggcctgtctgacccttgtttttgctgccaacacaacaagggwcagagcaaagcttgagctgacaaagcctttcttctccaccctgtcctcccaaccctcacgcctcttcctcccatcatcccacagctctgaaggtagacag

SEQ ID NO: 85022 - DNA, 201 bp, Homo sapiens
aggctgtccccatctccagctcagataaaaatgtctgagactgggaagtcctcctgacttctcagggcacttgtggtcaaaggaccctcctttcataacakatggggttgggggaggggcagtgcttcacatctgtaattccagctctttgagaggccaaggtggatggattgcttgagcctgggagttcaagaccagcct

SEQ ID NO: 85023 - DNA, 201 bp, Homo sapiens
actatttacacagtttggggtttaacttaaatatttattgtgtatcagccccttagatttccttgaaaaatctgttttgtaatgtatgtttacatgggttygtctaagcaggacctcagatcaaccactgatttgatcaaatcagtttaaaaacagggcatattgagcaattgatcttgctggggattttgttgttgttgc

SEQ ID NO: 85024 - DNA, 201 bp, Homo sapiens
gctcagataaaaatgtctgagactgggaagtcctcctgacttctcagggcacttgtggtcaaaggaccctcctttcataacagatggggttgggggagggrcagtgcttcacatctgtaattccagctctttgagaggccaaggtggatggattgcttgagcctgggagttcaagaccagcctgggcaacatagcgagacc

SEQ ID NO: 85025 - DNA, 201 bp, Homo sapiens
gggctgcatgaggaaataattacataacccaaaaaggaggccagaggttgtctaagtaagcttggagaaacaataattccaaaataagctgagaccaactytgtagcgtaatgaacattcaaagctgtgcagattcaacagaggagatggctgtgtcattaagaaattatgtccaacatcaaaagccaattaaaaaatgaa

SEQ ID NO: 85026 - DNA, 201 bp, Homo sapiens
gccttaacgaccagcttctgaaaactagaaagcagctgaagtgaccagagcagtttctgaggacagtccaaaagagtgctacaacatccccctggcttgayagctcaggacacctgtcctctgaacacagctgctgtaccaggaggaagccctaacaagcccacctggagagatcacctggagaaacctacgtggagagaa

SEQ ID NO: 85027 - DNA, 201 bp, Homo sapiens
aaaggaggccagaggttgtctaagtaagcttggagaaacaataattccaaaataagctgagaccaactttgtagcgtaatgaacattcaaagctgtgcagmttcaacagaggagatggctgtgtcattaagaaattatgtccaacatcaaaagccaattaaaaaatgaaggtgatgaaggtctggtcccctctggctaacg

SEQ ID NO: 85028 - DNA, 201 bp, Homo sapiens
cccacctggagagatcacctggagaaacctacgtggagagaaaccgaggcctcccagccgaccaccagtgtcagccactgacctgagtgaatgtgccttcygatgatttgagctcccagccctcaagacttccaactgaggaatagctgtcccgctgtaccctgtccgaacttcccacccacacaatccatgagcataata

SEQ ID NO: 85029 - DNA, 201 bp, Homo sapiens
tagagtagcactcaagcttccagcactgaagctgatgctgaagttctccatccccccactcccatcccatcctgcctagcccttgaatccaagtgtttatytgtttgtttttgcacttgatgctttgaaaataagaaaaacccaagactcacaatatcttctgttcctgctgggctagaatttggatcattttagtattat

SEQ ID NO: 85030 - DNA, 201 bp, Homo sapiens
aatatcttctgttcctgctgggctagaatttggatcattttagtattatctttgtttgttggggctactataacaaaacgccataagctgggtggctgatmaaccgcagagttttatttttcacatttttggggtctggaaaaccaagatcaaggtgctggtagattcggtgtttaataagggctcgatttctgatcatgg

SEQ ID NO: 85031 - DNA, 201 bp, Homo sapiens
cttctttctatgtgtacccaatttgtgtaagttctcctgttgtgaaagtggaaccattctatacgcactattctggaataaactctcaccatttattgaargcatcacatccatattcatatccatgtctatagtacagatatatctgtactatatccgtatctatactatagctatctatatctacagccatagctacag

SEQ ID NO: 85032 - DNA, 201 bp, Homo sapiens
tgctctcagacttgaatgaacacttccaggggtaattactgcaagactccaaattcatttctaggaagcagttgccggcggcctgcgcagaaggtaccgaygccattcaatatttatgaagcaacattccccaagaatatcaggccaggaaggcaactgtagaaacatcacccagtgaatatgaaaaccatttgctcgggg

SEQ ID NO: 85033 - DNA, 201 bp, Homo sapiens
aaatcccaggcagtcctttcctttccctctgtgaccaaatcaagcaacgccagatgctttctgtaggtcatatcttttcatcttcacagtaaccaaaaatyaggtcttagaggctatttctgctcctcttcctctccagcccaactctgcattctcacttccagctgaaagctttgcctgccatttaaaaaatccttgcca

SEQ ID NO: 85034 - DNA, 201 bp, Homo sapiens
atttaataattttttttttttgagatggagtctcactccgtcacccaagctggaaagcagaggcgcaatctcagctcactgcaacctctgcctcagcctcytgagtagctggggttacaggcgggtgccactacgcccggctaatttttgtacttttagtagagacagggtttcaccatgttggccaggatggtcttgaat

SEQ ID NO: 85035 - DNA, 201 bp, Homo sapiens
gaacattccagacaaatggaaagcatgcccaccaaacaagccaaggctctctaccaaaactctcaccaacgtggccatagtcgtgacttctctatcttcaraagttggaggtaaaatagatacatatgatttgaagtaaaacatttttttcctcatttcgtgatcatttataatctgtttttgggaattgcctgtttggtg

SEQ ID NO: 85036 - DNA, 201 bp, Homo sapiens
ttgtttttgctctaagaaatcatttccaaggccttttgaaagcctttttatctgaaatccttattccatcaaaattctgggcagagcactttttctccccsagacatgagcaggatgttgtatcaggaatctcagtggaggccttgtcacctggttgtccttccatctgacctcacacccaaaagcattggcctctcagtt

SEQ ID NO: 85037 - DNA, 201 bp, Homo sapiens
cacattttgcaaaaatgaaaacaaatgattaacgcatctgtatggtggtcagtggggcagagggaaaagggactggagtaggatattaatagggatagaargatggatgactggttggatggatagatgggtggatagataaattgatagataaaactagttggtggagacggataatattaccattcttgacccagcata

SEQ ID NO: 85038 - DNA, 201 bp, Homo sapiens
ctttcttttgctcagaattttaccaaaatttactcaccatttcatcaaatcatgtccctgtcagcaacatcgcttgtggtatttgagccacagaacacacytgtgttaaagcaacatttctaagctgattctaattcggtagacctggagtctggcttgggggtttattattaatgttttagtggccctctactcctgagt

SEQ ID NO: 85039 - DNA, 201 bp, Homo sapiens
ctcgaaccctggaggcggaggttgcagtgagccgaaattgcaacactgcactccagcctggtgacagaaggagactccatctcaaaaaaaaaaaaaaaaaraaaaaaagaaaaagaaagaaaagagaaaagaaattgaatatggagtttaaaaccttccagaaaaaaagaaaagaaaagaaaaaaaaaaaactccaggccc

SEQ ID NO: 85040 - DNA, 201 bp, Homo sapiens
ttctatcttaatataattggctatgaaaaggaaagttgctgtcgggaaaaaaaaaaaaaatcatcctctcctctgctcactttccccccagcggtccctgrgctcttgaggcttgaggcctttgcaaacgccattctctctgcctggaacgcctttcactcccggtccacacctacaccatgcgtggttcatactttctca

SEQ ID NO: 85041 - DNA, 201 bp, Homo sapiens
tattctcagccctgcaagagacccatggaaatcagattcctaaaaatccagaaaagttacatggacctctgctgtctcatgtagttgcttctgactctcgrcaaagcaattttgcgctccccaagttgtggggcgaaactgtccaccagcgggccagtcatgtttttggttgcgtctgtcggtacttttgtcatcaatgca

SEQ ID NO: 85042 - DNA, 201 bp, Homo sapiens
gtacttttagtagagacggaatttcaccatgttggtcaggctggtctcgaactcctgacttcaggtgatccacccacctcccgaagtgctgggattacagrcgtgaaccactgtccctggctcaaagccttttctatccattgccattctccttgcaaatccccacaggccaacaggagctacttacagagctcgggggct

SEQ ID NO: 85043 - DNA, 201 bp, Homo sapiens
gtagttgcttctgactctcggcaaagcaattttgcgctccccaagttgtggggcgaaactgtccaccagcgggccagtcatgtttttggttgcgtctgtcrgtacttttgtcatcaatgcatatgaaatgaagctgtttctggtttttcaattactgggccagggaccaggcctccctgactgttctgttcctgagttact

SEQ ID NO: 85044 - DNA, 201 bp, Homo sapiens
cacagctgcacctttgttacgtgtcatccatggctgctttcttgcaacaacggcagaattgagaagtggcaagagaggctggcaatatagcccccaaagcytaagatatttgttatctggtcctttatagaacatgtttaacctggaatagagcaaagaacaacaggtattcagggtggactgtgtgcccattgctgtgtt

SEQ ID NO: 85045 - DNA, 201 bp, Homo sapiens
agaagagatggatttgagcagtcccacctcctatgtctgccctgctcccgtaaccacaccaagaagcaagaagacagaacaaggcacagagcagcagccargaaaagaaaaatcctgcaccaggaatgagactcatggcctgggggtccctcgccctctcgcctagactcagccccctctgtcccagcatctctgacatca

SEQ ID NO: 85046 - DNA, 201 bp, Homo sapiens
gctgggtggctgataaaccgcagagttttatttttcacatttttggggtctggaaaaccaagatcaaggtgctggtagattcggtgtttaataagggctcratttctgatcatggatggtgacttctcactgcatcctcagttgtggaagggtcaaggcagctctctgggggtctcttttctaaggacaccaaccccattc

SEQ ID NO: 85047 - DNA, 201 bp, Homo sapiens
tggaaaaccaagatcaaggtgctggtagattcggtgtttaataagggctcgatttctgatcatggatggtgacttctcactgcatcctcagttgtggaagsgtcaaggcagctctctgggggtctcttttctaaggacaccaaccccattcatgagggctgcaaccctcatgacttaatcacccctcaagggccccacctc

SEQ ID NO: 85048 - DNA, 201 bp, Homo sapiens
tagattcggtgtttaataagggctcgatttctgatcatggatggtgacttctcactgcatcctcagttgtggaagggtcaaggcagctctctgggggtctsttttctaaggacaccaaccccattcatgagggctgcaaccctcatgacttaatcacccctcaagggccccacctcctgacatcatcaccttcatggatag

SEQ ID NO: 85049 - DNA, 201 bp, Homo sapiens
gtgattcattgttgttgaggcttgtgggtccacccccccacaaaaaaaaacagctagctttttttccttacatgaaactatttaaacttctgtccccagcrctagagaaaaaaaagatattgaaggttctgcattcctagtatgtcacctacttttcctcctccctcacacctgggaacagttcaaacttgaaagagaagt

SEQ ID NO: 85050 - DNA, 201 bp, Homo sapiens
ataccacttcacacccattaggatggctattatcaaaataacagaaagtaaccagtgttggtgaggatatggagaaatcggtacacttgagcaccactggwgaaaatgcaaatggtacagctgctgtgaaaaacagtatggcagctcctcagaagactaaaaatagaataatgacagccgggcagggtggctcatgcctgt

SEQ ID NO: 85051 - DNA, 201 bp, Homo sapiens
attaattacaggatctgttataaacagtcagctgcataactttggcagaaagcaaattcgtcatctcgagaggattttgctgttctaaataaataagtgcsattagggtgatgagcaaacttctacctacttcaacctccttcattttgaagagagagaaggacagagacagggtgcaaatttgagcaagatgggaagcat

SEQ ID NO: 85052 - DNA, 201 bp, Homo sapiens
gaacacagaaggcaaagccagaatctgtgatgctgcccttttgtggtagaatacattaaaatacaagtttaaatgttttgttaatgctttttttttttttkttttttttttactctttatgcatttaggggagaaaaaaactcaaaagaaatggcattcctgctggattaagtttagtgtggcttgatccagggcagcctg

SEQ ID NO: 85053 - DNA, 201 bp, Homo sapiens
gggctggggctttggctttgcacctgtgtgtacccaaaggtcttggacatcaacttaggttgagtagaactttctgagaaaagccagtcaaatgtcactgkcctcattgtccatacaagaaaaccaagaattggcgtttggtgggatcctgccacattacataggaaggtcttaaaagatccacagcagatgtctgtttgg

SEQ ID NO: 85054 - DNA, 201 bp, Homo sapiens
agaccactctctgggtctatggccttcagtagcttgaagccgacaccaccacttgtcttcactgggactaaaaatcaacaaaccctggatgagcctctcargcaccaggaggtgctagccaaataccaggatggagctggccctgccctctgggtcttctactctagttgaggtaaggaagttcagaaatagatcgccaag

SEQ ID NO: 85055 - DNA, 201 bp, Homo sapiens
ggctgaggtgggaggatcacttgagcctaggaggtcgaggctgcagtgagctgtgatggcgccactgcactccagcctctgggcaatagagcaagactttktctcaaaaaaaaaaatgcagacatctcattaatacttgtatacacttttatttttggacccagtcacccttccgtgccatacttatgggtttacttgttc

SEQ ID NO: 85056 - DNA, 201 bp, Homo sapiens
tgctgtgatggtccctgtgaatagccactgagctctggcctgtgcaatatagcgagatcccatctttaaaagataaagaagttctgccaagttgtatactrtaaatcttaattgaaatttgtcaaggtttgcccatccctgggatcgtgaaactggggaaaagtggtgggaatgatcctataacccttgtgttctaaccaa

SEQ ID NO: 85057 - DNA, 201 bp, Homo sapiens
acggaacaagtcccttttttctttgaaacagaacacctgccccacagtgggactgtgggagaagagaggtgacttgagtcaggaccccccgatggcactcrgtaaacatttacccactcaggtagagcctggacccaaggcttcagcacctgccacctacaagcaatctggggccacaaagcagtttgttctgacagctcc

SEQ ID NO: 85058 - DNA, 201 bp, Homo sapiens
cttgacagggtaagtataaatttggttcctctttggggcgatggacttttgggaagatatcacagaagttatgggcaacatccccaagaaaaactctcttkcccacccctgtctacagggatgtgcaggcccctgaagagcagccaggcacctggagaaagaggcctcctgtgtgggagaaggcactggagatttaggggc

SEQ ID NO: 85059 - DNA, 201 bp, Homo sapiens
gctgtgccagggcaggctctgggctaactgagcggggctggggtggagtgaggtcctcctgggaatgagcagatgtgggcctggtccgggagccacgttcytcaccacaaaaggctgacttactcgggagtgttgatccaaatgatgtccaggtggcaatagtagacacactccttgtccttgtaggtgaagcacgtgcag

SEQ ID NO: 85060 - DNA, 201 bp, Homo sapiens
atagatttatcacttacctcaaactactgagtctctattagagacacaggctttatcctcaagcaagatgccagggctgggattagggtgaggcaggtgargtaagtggagcaagctcagggctggatcctgcctttactaaaaacaatatttggtcgattatgaatttttttttgcactcattttggctttctgaaaata

SEQ ID NO: 85061 - DNA, 201 bp, Homo sapiens
ctaaaattatcttgaccaatcaagccacattttgagtagcaagattccctataaggcacataaccttggccttaatattgtaataacaacaacatcaccarttagaatgataacaaggtcttctctgatcgcgcttttaaaattgcaatcccccaaatgcttccccgttatccctgcactgtgtttccccaaagcacttac

SEQ ID NO: 85062 - DNA, 201 bp, Homo sapiens
gccattaagaatgttgcaatttatctcagataagcatcccctcaagttgtctctttatgtgctttatgattctttgaagattgtttttcctttaatttaarggatttaagggagagtaacataatacattatgtagttttccatcatgctggaatttcttctccccacccacccacagcagcaggaactctggacttactc

SEQ ID NO: 85063 - DNA, 201 bp, Homo sapiens
tatatttgcgttcttaacgggcgtataatataaagatgaacagtaaaattcatgctaaacattgtttctttacttggaaggacactaaataacaaaaaacwctatgatgagagacaaaaagagagactatgaaagaaaaagaaacaatgttttcgtacctttagtgatacctttttttgctttttgatcaagagtcttata

SEQ ID NO: 85064 - DNA, 201 bp, Homo sapiens
agtcttagggagaatggaggcaggagttttaaaggtcataaaaatttcaagcgaaagagatgctccaaatctcttagaaaaaattgtcaacagaaaagaarggaaataaaggtcacatgattatgaaatggaagggcacaaaccccaaggtggcattcattttgcatttaagtcctgtatcagattgccagcatcctctct

SEQ ID NO: 85065 - DNA, 201 bp, Homo sapiens
ttctaacaaaagccaggtttctgtccacttcccctggcattctggtttgcccttgaactcagcatcaagttctggggttagcccgtgtggcatcttgctckcctcctactgatcttcttgcaccaccatagtgaggaccacatgtgcacaggcacgcgcagagagatcctatcagtcgcagcaaccatgggctgagcctac

SEQ ID NO: 85066 - DNA, 201 bp, Homo sapiens
aaaaaataaccttctaaggcagctactattgtttttcccaattgacaggtaaggaaacggtccaggtgagttcagaatcattgtctcctaagctgatgatyattctagtatcttctgggaccctgctttaaggctcctgtttacaccagggcccctgagaattagatcatgaaagatttccaagggatagtttctctgctc

SEQ ID NO: 85067 - DNA, 201 bp, Homo sapiens
tggttagatggagatttacagcattaaaatgtttatatttgaaaagaagaaaaagctaaaaacagtaaccaaagcttttacttcaataaactagagaaagaaaagtaaatttaaactcaaaggaagcagaaggaaagaaataatgaagagaaaagcagaaatcaataaaattgaaaacagaaaagaatgaagacaaataat

SEQ ID NO: 85068 - DNA, 201 bp, Homo sapiens
aaaaaactcaaaagaaatggcattcctgctggattaagtttagtgtggcttgatccagggcagcctgggaagccggcctgggcatcttgataggagctgakcagactgttgggattaggagagacttggcagctcactgtcctggagcggctgatgtctgcaccttccagagggtcacagagaggcaacagcacctcctgg

SEQ ID NO: 85069 - DNA, 201 bp, Homo sapiens
cgtctcaaaagcacatcatgaaatgatgttttctaaatagatgtctgtgggatttcctcgattgcttcctggtgactcccagttggtgacacccacttcargtcctgggcaatgctgggtgaagtcagaagtgaggctactggtgccccatggggtcctcagctgcaaattacaaggcattatatctactctgctggacgt

SEQ ID NO: 85070 - DNA, 201 bp, Homo sapiens
aatacggcgaccctatgagggatgctccgctgcaccatcaactctcttttcagattacaggtcaaggacagcttcttggggaaaactctgacctctcaggytaggttgagtcacccattgctgatgctccggagaagacccaggacttctccttagagcatacttcagcatttctgaagataccactttctctgatcctgt

SEQ ID NO: 85071 - DNA, 201 bp, Homo sapiens
gggaggagcacagtggggctctttgctgggtgcttcacagctcagtcagccattggataaacaggttttcagtcttcagccaggctctgaggggctggtcygccatgaaatgtggttcgagctgacatccccgttatgggtcactttaggtgtcaacttggctaggatactgtgcccagttgtttagtcaaacagcagcct

SEQ ID NO: 85072 - DNA, 201 bp, Homo sapiens
aaatttggttcctctttggggcgatggacttttgggaagatatcacagaagttatgggcaacatccccaagaaaaactctcttgcccacccctgtctacarggatgtgcaggcccctgaagagcagccaggcacctggagaaagaggcctcctgtgtgggagaaggcactggagatttaggggctcagcaacagcaaagat

SEQ ID NO: 85073 - DNA, 201 bp, Homo sapiens
agtctgagaaaattgtcacagatcaaaaaggcctaagaagaaaactaaatgtaaggtggtgtcctggatgggaccctggaccagagagggacattaggaaraaatgagtgcagtttgaattagccatggagttcagttaatagtaatgtgccgatgttagctttgcagctgtggcagacgcactacagaaatgtaagatga

SEQ ID NO: 85074 - DNA, 201 bp, Homo sapiens; identical to SEQ ID NO: 84696

SEQ ID NO: 85075 - DNA, 201 bp, Homo sapiens
cataacagtgcctgcaggtggctgtgaatctcaaacaggtgctggttccaccggcagtgctgggcgtcactggaggctctcattccaggttcccatattgyaatgcacaaggttctgagttgacaccactgcaaaggcattggctgtataatgtttagaaaaagagattcctccctctgcttcccctgggccttcttggta

SEQ ID NO: 85076 - DNA, 201 bp, Homo sapiens
gaccgcatgcacgcacacacacacacacacacacacacacacacacagtctcaacttatctcaaacaacatgtgtgtactttaactggagccttcaatgcytcagccaaagttgggaatttcaagcatctcagcagatacatgggagagatgcttttgaataagttaagtcaacatgccacaaacacacctgtgtgtttta

SEQ ID NO: 85077 - DNA, 201 bp, Homo sapiens
ggtaggagatgggactccactgtggaggtggggcttggacaccagaccaaattgagaactaactaaaacagggacagggtagaagctgctttccgtaagayatgcccagcaatgtgccatgtcagtttaccattgccttggcagcacctgaaagttatcgccctttccgtgacagcaacccagtgatctagaagttgccac

SEQ ID NO: 85078 - DNA, 201 bp, Homo sapiens
aaatacctctggtttttgttatgtggtgcaggattttcaagacttatggctaaaaaaaaaattagagaaacaaactcctccaaaacttggggaattaagcygtctatggaatcctacagattagcagtttccctccatctggtacaaccaaaatgcatcaaacgagttaggctagagtttctctccccagcccccagtgac

SEQ ID NO: 85079 - DNA, 201 bp, Homo sapiens
agatgggggcatctcttgagaccaagaggcagaggttgcagtgagctgagatggcgccactgcattccagcctggacaacagagtgagaacctgtctcggaaaaaaaaaaaaaaaaaaaaaaaagtgagcaaatgaagacattggtgtccagagaatctaattcctatggaggatgtatggctttcaggggcagcaaaggc

SEQ ID NO: 85080 - DNA, 201 bp, Homo sapiens
caaaatagttcccagcagtggaaagagaagagggaaaacagggagcaagtattttcataaggatggggttatgtgcaaagggattaaaaaaaatgccgacwccatgatacatgctttgaataatctaaagaaagcaagagaagacactcttgctaattttcaggagataccaggttaaggatggaaaagatcttcatgagc

SEQ ID NO: 85081 - DNA, 201 bp, Homo sapiens
caccaaaaccaagatggcaacccaagtgaccttctgttgtcctcactgctcattatatgctaattataatgcattagccactaaaagacactcccaccagygccatgacagtttacaaatgccatggcaacatcaggaagtcaccctatatggtctaggaagggggaacctcagttccaggaattcatgaataacccaccc

SEQ ID NO: 85082 - DNA, 201 bp, Homo sapiens
ttgtcctcactgctcattatatgctaattataatgcattagccactaaaagacactcccaccagcgccatgacagtttacaaatgccatggcaacatcagraagtcaccctatatggtctaggaagggggaacctcagttccaggaattcatgaataacccaccccttgtttagcataggatcgaaaaataactgtaagta

SEQ ID NO: 85083 - DNA, 201 bp, Homo sapiens
attataatgcattagccactaaaagacactcccaccagcgccatgacagtttacaaatgccatggcaacatcaggaagtcaccctatatggtctaggaagrgggaacctcagttccaggaattcatgaataacccaccccttgtttagcataggatcgaaaaataactgtaagtatactcaatcaagcagcccataccact

SEQ ID NO: 85084 - DNA, 201 bp, Homo sapiens
gagcagagactcaaagaggcgaacccacgcagtcatgggaagtgttccacacaggtggaagtacacggtaggaatggacttcctgggttctgggaggagcratacggcgaccctatgagggatgctccgctgcaccatcaactctcttttcagattacaggtcaaggacagcttcttggggaaaactctgacctctcaggc

SEQ ID NO: 85085 - DNA, 201 bp, Homo sapiens
ttggctttaaaaaaaaaaaaaaagaaaaaaaaaaccttagaattaaactcttagttactgagatgtcgcaactcacatcactatgaaagtcatgtaaaagsgttctgtgtttgtccctttattcattcaactacttattaagcacctactgggagtcagacactttttctaagtactaagattacccctgggaacaagatg

SEQ ID NO: 85086 - DNA, 201 bp, Homo sapiens
ggaggaaatgggaatcatttggctttaaaaaaaaaaaaaaagaaaaaaaaaaccttagaattaaactcttagttactgagatgtcgcaactcacatcactrtgaaagtcatgtaaaagggttctgtgtttgtccctttattcattcaactacttattaagcacctactgggagtcagacactttttctaagtactaagatt

SEQ ID NO: 85087 - DNA, 201 bp, Homo sapiens
aagaaatttcacaattgtgtttttaatgagctcaaaccactttagcaggacacagttaaacaaaagagtaacacaatcaagcccggaagtcataattcagrttcagaaatgcagggggggcaggatttgacctggtaccttctcagagacgtaggactccgagagagcaaaatctcctgccggaacgtgctgatggattgg

SEQ ID NO: 85088 - DNA, 201 bp, Homo sapiens
gaactcagcatcaagttctggggttagcccgtgtggcatcttgctcgcctcctactgatcttcttgcaccaccatagtgaggaccacatgtgcacaggcaygcgcagagagatcctatcagtcgcagcaaccatgggctgagcctactgagtgcctggctgtctacacgcatcatctcattgttttctcagaacaacccct

SEQ ID NO: 85089 - DNA, 201 bp, Homo sapiens
aaccatgcagggaagagagaaagagtggccatttggaccccgaagcagcacattatacaaccatccaatgcaatgctaacctggagcctcatacccatagwcagaccacttcctgatggaagggcacagattccatctctcaacagcacccagcccttgggggaaaaaggtaaaggaagtcgatttgtttttggaatctct

SEQ ID NO: 85090 - DNA, 201 bp, Homo sapiens
aataaatgcttagtttttttctagaaagtctgaaatttcacagttctagcaggcaagacataagtgctcgttcaaaaccatctctggtgggagtagaaacyatgcagggaagagagaaagagtggccatttggaccccgaagcagcacattatacaaccatccaatgcaatgctaacctggagcctcatacccatagacag

SEQ ID NO: 85091 - DNA, 21 bp, Homo sapiens
agctgttcgtgttctatgatc

SEQ ID NO: 85092 - DNA, 21 bp, Homo sapiens
agctgttcgtgttctatgatg

SEQ ID NO: 85093 - DNA, 22 bp, Homo sapiens
gaagtcaacagtgaacatgtga

SEQ ID NO: 85094 - DNA, 18 bp, Homo sapiens
cactcacactggggaaga

SEQ ID NO: 85095 - DNA, 17 bp, Homo sapiens
actcacactggggaagg

SEQ ID NO: 85096 - DNA, 19 bp, Homo sapiens
ccttccaggtgaaggtcac

SEQ ID NO: 85097 - DNA, 16 bp, Homo sapiens
tcccaatcccaggaca

SEQ ID NO: 85098 - DNA, 15 bp, Homo sapiens
cccaatcccaggacg

SEQ ID NO: 85099 - DNA, 23 bp, Homo sapiens
tgacattgcactctcaaatattt

SEQ ID NO: 85100 - DNA, 24 bp, Homo sapiens
caaaatgtagaaggttcatatgag

SEQ ID NO: 85101 - DNA, 24 bp, Homo sapiens
caaaatgtagaaggttcatatgac

SEQ ID NO: 85102 - DNA, 23 bp, Homo sapiens
gagctgtgtgtttctttgttcta

SEQ ID NO: 85103 - DNA, 15 bp, Homo sapiens
gcgcacccaggtcag

SEQ ID NO: 85104 - DNA, 15 bp, Homo sapiens
gcgcacccaggtcaa

SEQ ID NO: 85105 - DNA, 19 bp, Homo sapiens
ccacgttctggtcgatctt

SEQ ID NO: 85106 - DNA, 17 bp, Homo sapiens
gctggagttcatgtcgc

SEQ ID NO: 85107 - DNA, 17 bp, Homo sapiens
gctggagttcatgtcgg

SEQ ID NO: 85108 - DNA, 19 bp, Homo sapiens
ccttggctgtgtggtacag

SEQ ID NO: 85109 - DNA, 24 bp, Homo sapiens
gtctttagaagcctcttcagaata

SEQ ID NO: 85110 - DNA, 22 bp, Homo sapiens
ctttagaagcctcttcagaatg

SEQ ID NO: 85111 - DNA, 17 bp, Homo sapiens
cggctttggcctacaag

SEQ ID NO: 85112 - DNA, 22 bp, Homo sapiens
gggtaaaattcagtaaggttgg

SEQ ID NO: 85113 - DNA, 23 bp, Homo sapiens
agggtaaaattcagtaaggttga

SEQ ID NO: 85114 - DNA, 22 bp, Homo sapiens
tcgctatccaagtgaacatatc

SEQ ID NO: 85115 - DNA, 18 bp, Homo sapiens
ggctgttgtctcaccctc

SEQ ID NO: 85116 - DNA, 18 bp, Homo sapiens
ggctgttgtctcaccctg

SEQ ID NO: 85117 - DNA, 24 bp, Homo sapiens
tgtcatcagatgaagaagagagaa

SEQ ID NO: 85118 - DNA, 26 bp, Homo sapiens
ctctctttctagaaactgaagaaatt

SEQ ID NO: 85119 - DNA, 25 bp, Homo sapiens
tctctttctagaaactgaagaaatc

SEQ ID NO: 85120 - DNA, 18 bp, Homo sapiens
gggcagggctaggagtag

SEQ ID NO: 85121 - DNA, 17 bp, Homo sapiens
actgtcacctgttgggg

SEQ ID NO: 85122 - DNA, 18 bp, Homo sapiens
gactgtcacctgttggga

SEQ ID NO: 85123 - DNA, 17 bp, Homo sapiens
ccagggttgggctactg

SEQ ID NO: 85124 - DNA, 14 bp, Homo sapiens
cgtgaccctgccgt

SEQ ID NO: 85125 - DNA, 14 bp, Homo sapiens
cgtgaccctgccgc

SEQ ID NO: 85126 - DNA, 16 bp, Homo sapiens
gggccagcatgtggac

SEQ ID NO: 85127 - DNA, 19 bp, Homo sapiens
cagtccatggttccttcat

SEQ ID NO: 85128 - DNA, 19 bp, Homo sapiens
cagtccatggttccttcac

SEQ ID NO: 85129 - DNA, 19 bp, Homo sapiens
ctccacctgcatttcagag

SEQ ID NO: 85130 - DNA, 14 bp, Homo sapiens
ggacccccgaaggc

SEQ ID NO: 85131 - DNA, 15 bp, Homo sapiens
tggacccccgaagga

SEQ ID NO: 85132 - DNA, 18 bp, Homo sapiens
ggccccaacagttgactg

SEQ ID NO: 85133 - DNA, 18 bp, Homo sapiens
gcgtgatgatgaaatcga

SEQ ID NO: 85134 - DNA, 18 bp, Homo sapiens
gcgtgatgatgaaatcgg

SEQ ID NO: 85135 - DNA, 20 bp, Homo sapiens
agcctctcctgactgtcatc

SEQ ID NO: 85136 - DNA, 15 bp, Homo sapiens
gcagcagtcgccctt

SEQ ID NO: 85137 - DNA, 15 bp, Homo sapiens
gcagcagtcgccctg

SEQ ID NO: 85138 - DNA, 24 bp, Homo sapiens
cattttgctgatgtttgtttctag

SEQ ID NO: 85139 - DNA, 18 bp, Homo sapiens
ggttacaggctccaggac

SEQ ID NO: 85140 - DNA, 18 bp, Homo sapiens
ggttacaggctccaggat

SEQ ID NO: 85141 - DNA, 20 bp, Homo sapiens
ctgatggccaaaagaagagt

SEQ ID NO: 85142 - DNA, 14 bp, Homo sapiens
gccctacagcgggt

SEQ ID NO: 85143 - DNA, 12 bp, Homo sapiens
cctacagcgggc

SEQ ID NO: 85144 - DNA, 22 bp, Homo sapiens
gacggatctgacagaatctttc

SEQ ID NO: 85145 - DNA, 17 bp, Homo sapiens
gacactgccctcatcgt

SEQ ID NO: 85146 - DNA, 15 bp, Homo sapiens
cactgccctcatcgc

SEQ ID NO: 85147 - DNA, 20 bp, Homo sapiens
cctgtccttgaggtctgatc

SEQ ID NO: 85148 - DNA, 19 bp, Homo sapiens
actgtcctgtctctcctcg

SEQ ID NO: 85149 - DNA, 20 bp, Homo sapiens
gactgtcctgtctctcctca

SEQ ID NO: 85150 - DNA, 18 bp, Homo sapiens
ttgccagccatgactaga

SEQ ID NO: 85151 - DNA, 15 bp, Homo sapiens
tcgcaggtgtcccta

SEQ ID NO: 85152 - DNA, 14 bp, Homo sapiens
cgcaggtgtccctg

SEQ ID NO: 85153 - DNA, 15 bp, Homo sapiens
ccccatcccttctca

SEQ ID NO: 85154 - DNA, 16 bp, Homo sapiens
tccacgtggaccaggt

SEQ ID NO: 85155 - DNA, 15 bp, Homo sapiens
ccacgtggaccaggc

SEQ ID NO: 85156 - DNA, 19 bp, Homo sapiens
gcccaggtatttcatcagc

SEQ ID NO: 85157 - DNA, 23 bp, Homo sapiens
cagttttccatgggttctactac

SEQ ID NO: 85158 - DNA, 23 bp, Homo sapiens
cagttttccatgggttctactat

SEQ ID NO: 85159 - DNA, 25 bp, Homo sapiens
ttatgaaatggtacagacaagtgat

SEQ ID NO: 85160 - DNA, 23 bp, Homo sapiens
cagttttccatgggttctactat

SEQ ID NO: 85161 - DNA, 23 bp, Homo sapiens
cagttttccatgggttctactac

SEQ ID NO: 85162 - DNA, 25 bp, Homo sapiens
ttatgaaatggtacagacaagtgat

SEQ ID NO: 85163 - DNA, 23 bp, Homo sapiens
ccagttttggtgtcaactagaaa

SEQ ID NO: 85164 - DNA, 23 bp, Homo sapiens
ccagttttggtgtcaactagaag

SEQ ID NO: 85165 - DNA, 23 bp, Homo sapiens
ttgcaacctgaaaaacataacta

SEQ ID NO: 85166 - DNA, 18 bp, Homo sapiens
tcccttagtccggatgat

SEQ ID NO: 85167 - DNA, 18 bp, Homo sapiens
tcccttagtccggatgac

SEQ ID NO: 85168 - DNA, 21 bp, Homo sapiens
gactcttttgcaggaatgtgt

SEQ ID NO: 85169 - DNA, 18 bp, Homo sapiens
ctccatcattgcagacca

SEQ ID NO: 85170 - DNA, 17 bp, Homo sapiens
tccatcattgcagaccg

SEQ ID NO: 85171 - DNA, 20 bp, Homo sapiens
ccaattcccctgatgttaaa

SEQ ID NO: 85172 - DNA, 15 bp, Homo sapiens
actggccccttgcat

SEQ ID NO: 85173 - DNA, 15 bp, Homo sapiens
actggccccttgcag

SEQ ID NO: 85174 - DNA, 19 bp, Homo sapiens
aggagggaaccaaacctta

SEQ ID NO: 85175 - DNA, 15 bp, Homo sapiens
tctggcttccgggaa

SEQ ID NO: 85176 - DNA, 15 bp, Homo sapiens
tctggcttccgggag

SEQ ID NO: 85177 - DNA, 22 bp, Homo sapiens
cgtagctgttgaccatcattta

SEQ ID NO: 85178 - DNA, 19 bp, Homo sapiens
agattttcacccatccatg

SEQ ID NO: 85179 - DNA, 20 bp, Homo sapiens
gagattttcacccatccatc

SEQ ID NO: 85180 - DNA, 21 bp, Homo sapiens
tgccgactcagaaactctcta

SEQ ID NO: 85181 - DNA, 21 bp, Homo sapiens
tgtccagatccacatagaaca

SEQ ID NO: 85182 - DNA, 22 bp, Homo sapiens
ttgtccagatccacatagaact

SEQ ID NO: 85183 - DNA, 18 bp, Homo sapiens
ctttatgcagcggaccat

SEQ ID NO: 85184 - DNA, 22 bp, Homo sapiens
aagaggtcctgaatcttctctc

SEQ ID NO: 85185 - DNA, 22 bp, Homo sapiens
aagaggtcctgaatcttctctt

SEQ ID NO: 85186 - DNA, 21 bp, Homo sapiens
atgaaatgggtcaacaaaact

SEQ ID NO: 85187 - DNA, 24 bp, Homo sapiens
atgtgaacttagcacttttatcag

SEQ ID NO: 85188 - DNA, 24 bp, Homo sapiens
atgtgaacttagcacttttatcaa

SEQ ID NO: 85189 - DNA, 19 bp, Homo sapiens
aaccttccgtggaaagaga

SEQ ID NO: 85190 - DNA, 22 bp, Homo sapiens
cgacttaagggtgtagtgtgac

SEQ ID NO: 85191 - DNA, 22 bp, Homo sapiens
cgacttaagggtgtagtgtgat

SEQ ID NO: 85192 - DNA, 17 bp, Homo sapiens
ccgaaaacggaagcatc

SEQ ID NO: 85193 - DNA, 14 bp, Homo sapiens
gctgctctgcgccg

SEQ ID NO: 85194 - DNA, 14 bp, Homo sapiens
gctgctctgcgcca

SEQ ID NO: 85195 - DNA, 19 bp, Homo sapiens
gccctctgcgtacctaagg

SEQ ID NO: 85196 - DNA, 18 bp, Homo sapiens
cctcatggagatctttca

SEQ ID NO: 85197 - DNA, 18 bp, Homo sapiens
cctcatggagatctttcg

SEQ ID NO: 85198 - DNA, 16 bp, Homo sapiens
gaggccagcgaggaga

SEQ ID NO: 85199 - DNA, 17 bp, Homo sapiens
tgtcggtaaacatggca

SEQ ID NO: 85200 - DNA, 16 bp, Homo sapiens
gtcggtaaacatggcg

SEQ ID NO: 85201 - DNA, 19 bp, Homo sapiens
ggtgggtggtctgactctc

SEQ ID NO: 85202 - DNA, 15 bp, Homo sapiens
ggctgtgcctgggac

SEQ ID NO: 85203 - DNA, 15 bp, Homo sapiens
ggctgtgcctgggat

SEQ ID NO: 85204 - DNA, 20 bp, Homo sapiens
gaaggcagggacttttatca

SEQ ID NO: 85205 - DNA, 15 bp, Homo sapiens
gctgccctcagtccg

SEQ ID NO: 85206 - DNA, 16 bp, Homo sapiens
tgctgccctcagtcca

SEQ ID NO: 85207 - DNA, 19 bp, Homo sapiens
gggcactgccaattcttag

SEQ ID NO: 85208 - DNA, 15 bp, Homo sapiens
ggcctctagggggcc

SEQ ID NO: 85209 - DNA, 16 bp, Homo sapiens
aggcctctagggggct

SEQ ID NO: 85210 - DNA, 18 bp, Homo sapiens
ccccatttgcacacagac

SEQ ID NO: 85211 - DNA, 14 bp, Homo sapiens
cggcctgcgtggac

SEQ ID NO: 85212 - DNA, 14 bp, Homo sapiens
cggcctgcgtggat

SEQ ID NO: 85213 - DNA, 16 bp, Homo sapiens
gcccagggcgtgttct

SEQ ID NO: 85214 - DNA, 16 bp, Homo sapiens
tccgggtgcacgtata

SEQ ID NO: 85215 - DNA, 14 bp, Homo sapiens
cgggtgcacgtatg

SEQ ID NO: 85216 - DNA, 22 bp, Homo sapiens
tggagagtgtttgctcatctac

SEQ ID NO: 85217 - DNA, 22 bp, Homo sapiens
tgttttcatccacttgaactgt

SEQ ID NO: 85218 - DNA, 20 bp, Homo sapiens
ttttcatccacttgaactgc

SEQ ID NO: 85219 - DNA, 21 bp, Homo sapiens
caattttggctcccttaaaag

SEQ ID NO: 85220 - DNA, 17 bp, Homo sapiens
ggacgtgctccaggatg

SEQ ID NO: 85221 - DNA, 17 bp, Homo sapiens
ggacgtgctccaggatt

SEQ ID NO: 85222 - DNA, 21 bp, Homo sapiens
ggttcacattttggttcacaa

SEQ ID NO: 85223 - DNA, 17 bp, Homo sapiens
ctgaggcctatgtcctc

SEQ ID NO: 85224 - DNA, 17 bp, Homo sapiens
ctgaggcctatgtcctt

SEQ ID NO: 85225 - DNA, 21 bp, Homo sapiens
agctctcctttgttgctactg

SEQ ID NO: 85226 - DNA, 17 bp, Homo sapiens
cggttgaagtccttgat

SEQ ID NO: 85227 - DNA, 17 bp, Homo sapiens
cggttgaagtccttgac

SEQ ID NO: 85228 - DNA, 20 bp, Homo sapiens
ggttgtgcagagacatctga

SEQ ID NO: 85229 - DNA, 21 bp, Homo sapiens
atctcacaaatgatcgctatg

SEQ ID NO: 85230 - DNA, 22 bp, Homo sapiens
aatctcacaaatgatcgctatc

SEQ ID NO: 85231 - DNA, 21 bp, Homo sapiens
caggctccatctcacagatac

SEQ ID NO: 85232 - DNA, 18 bp, Homo sapiens
cgcacaccaggttctcat

SEQ ID NO: 85233 - DNA, 18 bp, Homo sapiens
cgcacaccaggttctcac

SEQ ID NO: 85234 - DNA, 21 bp, Homo sapiens
gcaactacctgggccactata

SEQ ID NO: 85235 - DNA, 20 bp, Homo sapiens
ggtttcattgcatggtttct

SEQ ID NO: 85236 - DNA, 19 bp, Homo sapiens
gtttcattgcatggtttcc

SEQ ID NO: 85237 - DNA, 26 bp, Homo sapiens
gggtactgaatttttaaaaggtttta

SEQ ID NO: 85238 - DNA, 15 bp, Homo sapiens
cccccactctccagc

SEQ ID NO: 85239 - DNA, 15 bp, Homo sapiens
cccccactctccagg

SEQ ID NO: 85240 - DNA, 19 bp, Homo sapiens
ggcaaaagcactgtgaaga

SEQ ID NO: 85241 - DNA, 15 bp, Homo sapiens
gactgcccgtcagca

SEQ ID NO: 85242 - DNA, 15 bp, Homo sapiens
gactgcccgtcagcc

SEQ ID NO: 85243 - DNA, 20 bp, Homo sapiens
ggaggtcaggtggatgttta

SEQ ID NO: 85244 - DNA, 24 bp, Homo sapiens
actgtaatttttttaaaggtcctg

SEQ ID NO: 85245 - DNA, 24 bp, Homo sapiens
actgtaatttttttaaaggtcctc

SEQ ID NO: 85246 - DNA, 30 bp, Homo sapiens
ggatgtatatcatctatcttcacagtatat

SEQ ID NO: 85247 - DNA, 14 bp, Homo sapiens
ctgcggctccacct

SEQ ID NO: 85248 - DNA, 13 bp, Homo sapiens
tgcggctccacca

SEQ ID NO: 85249 - DNA, 18 bp, Homo sapiens
tggcatctgccatactca

SEQ ID NO: 85250 - DNA, 22 bp, Homo sapiens
ggtaccatggactgtactcact

SEQ ID NO: 85251 - DNA, 21 bp, Homo sapiens
gtaccatggactgtactcacc

SEQ ID NO: 85252 - DNA, 20 bp, Homo sapiens
aggttggttctggagatgac

SEQ ID NO: 85253 - DNA, 14 bp, Homo sapiens
gggtccggccacac

SEQ ID NO: 85254 - DNA, 14 bp, Homo sapiens
gggtccggccacat

SEQ ID NO: 85255 - DNA, 16 bp, Homo sapiens
gggcccctcagtgaag

SEQ ID NO: 85256 - DNA, 21 bp, Homo sapiens
tgttcttccttatgatgatgt

SEQ ID NO: 85257 - DNA, 20 bp, Homo sapiens
gttcttccttatgatgatgc

SEQ ID NO: 85258 - DNA, 21 bp, Homo sapiens
ggcgttcctctcaccttaata

SEQ ID NO: 85259 - DNA, 21 bp, Homo sapiens
gccatcatttgcttctaacac

SEQ ID NO: 85260 - DNA, 21 bp, Homo sapiens
gccatcatttgcttctaacat

SEQ ID NO: 85261 - DNA, 22 bp, Homo sapiens
gcttatttgccagaaaacattt

SEQ ID NO: 85262 - DNA, 17 bp, Homo sapiens
gcagtacttgcttaggg

SEQ ID NO: 85263 - DNA, 18 bp, Homo sapiens
cgcagtacttgcttagga

SEQ ID NO: 85264 - DNA, 23 bp, Homo sapiens
gccacctttatttctttagtgaa

SEQ ID NO: 85265 - DNA, 23 bp, Homo sapiens
gagcaccttaactatagatggtg

SEQ ID NO: 85266 - DNA, 24 bp, Homo sapiens
tgagcaccttaactatagatggta

SEQ ID NO: 85267 - DNA, 22 bp, Homo sapiens
cttgtcaaggcacagaataatt

SEQ ID NO: 85268 - DNA, 21 bp, Homo sapiens
tgaagaagctaaggattgagg

SEQ ID NO: 85269 - DNA, 21 bp, Homo sapiens
tgaagaagctaaggattgagc

SEQ ID NO: 85270 - DNA, 18 bp, Homo sapiens
ctctccctggctgagttg

SEQ ID NO: 85271 - DNA, 17 bp, Homo sapiens
gcactcttggacaagcg

SEQ ID NO: 85272 - DNA, 18 bp, Homo sapiens
tgcactcttggacaagca

SEQ ID NO: 85273 - DNA, 22 bp, Homo sapiens
aatgacatcccctatctttctg

SEQ ID NO: 85274 - DNA, 19 bp, Homo sapiens
gtaccttcacccatggaac

SEQ ID NO: 85275 - DNA, 19 bp, Homo sapiens
gtaccttcacccatggaat

SEQ ID NO: 85276 - DNA, 24 bp, Homo sapiens
tcactttctgttgattacatgaga

SEQ ID NO: 85277 - DNA, 18 bp, Homo sapiens
ctggctgggtcactaacc

SEQ ID NO: 85278 - DNA, 19 bp, Homo sapiens
gctggctgggtcactaact

SEQ ID NO: 85279 - DNA, 20 bp, Homo sapiens
cctcacctgcattcacattt

SEQ ID NO: 85280 - DNA, 17 bp, Homo sapiens
cagccaagagcaggaca

SEQ ID NO: 85281 - DNA, 16 bp, Homo sapiens
agccaagagcaggacg

SEQ ID NO: 85282 - DNA, 20 bp, Homo sapiens
cccaagacacgttcagaaat

SEQ ID NO: 85283 - DNA, 20 bp, Homo sapiens
acagaatcaggcaatatcca

SEQ ID NO: 85284 - DNA, 19 bp, Homo sapiens
cagaatcaggcaatatccg

SEQ ID NO: 85285 - DNA, 24 bp, Homo sapiens
tttgtagaccagtgaagaagtgat

SEQ ID NO: 85286 - DNA, 19 bp, Homo sapiens
cccctgttgaggagtattg

SEQ ID NO: 85287 - DNA, 20 bp, Homo sapiens
gcccctgttgaggagtatta

SEQ ID NO: 85288 - DNA, 20 bp, Homo sapiens
gttctgccagggaatctcta

SEQ ID NO: 85289 - DNA, 17 bp, Homo sapiens
ttggtacctggctctct

SEQ ID NO: 85290 - DNA, 16 bp, Homo sapiens
tggtacctggctctcc

SEQ ID NO: 85291 - DNA, 26 bp, Homo sapiens
aaacttcttaggacagagtgattaga

SEQ ID NO: 85292 - DNA, 19 bp, Homo sapiens
tcaaggcttaatgccactc

SEQ ID NO: 85293 - DNA, 19 bp, Homo sapiens
tcaaggcttaatgccactt

SEQ ID NO: 85294 - DNA, 25 bp, Homo sapiens
cgtaagtctgtgatttgtcaatact

SEQ ID NO: 85295 - DNA, 15 bp, Homo sapiens
cacggcggtcatgtg

SEQ ID NO: 85296 - DNA, 16 bp, Homo sapiens
ccacggcggtcatgta

SEQ ID NO: 85297 - DNA, 19 bp, Homo sapiens
ggtggagcttggtttctca

SEQ ID NO: 85298 - DNA, 20 bp, Homo sapiens
caggggagtaaaggtgactc

SEQ ID NO: 85299 - DNA, 20 bp, Homo sapiens
caggggagtaaaggtgactt

SEQ ID NO: 85300 - DNA, 17 bp, Homo sapiens
gctcagccagccagaaa

SEQ ID NO: 85301 - DNA, 21 bp, Homo sapiens
agagaatgttacctctcctga

SEQ ID NO: 85302 - DNA, 20 bp, Homo sapiens
gagaatgttacctctcctgg

SEQ ID NO: 85303 - DNA, 20 bp, Homo sapiens
ttctcctgggtcagattctc

SEQ ID NO: 85304 - DNA, 15 bp, Homo sapiens
gcgcaccagcttcag

SEQ ID NO: 85305 - DNA, 15 bp, Homo sapiens
gcgcaccagcttcac

SEQ ID NO: 85306 - DNA, 25 bp, Homo sapiens
tgtaatacatgattttcagacacac

SEQ ID NO: 85307 - DNA, 17 bp, Homo sapiens
catcacggagatccacc

SEQ ID NO: 85308 - DNA, 19 bp, Homo sapiens
atcatcacggagatccact

SEQ ID NO: 85309 - DNA, 22 bp, Homo sapiens
tcagctccaaggagattcttag

SEQ ID NO: 85310 - DNA, 17 bp, Homo sapiens
ctggcagcgaatgttat

SEQ ID NO: 85311 - DNA, 17 bp, Homo sapiens
ctggcagcgaatgttac

SEQ ID NO: 85312 - DNA, 25 bp, Homo sapiens
cctctagaaagaaaatggactgtat

SEQ ID NO: 85313 - DNA, 15 bp, Homo sapiens
gcggtagcagcagcg

SEQ ID NO: 85314 - DNA, 15 bp, Homo sapiens
gcggtagcagcagca

SEQ ID NO: 85315 - DNA, 18 bp, Homo sapiens
aggccctcctaccttttg

SEQ ID NO: 85316 - DNA, 18 bp, Homo sapiens
tcagcttcttcactgcta

SEQ ID NO: 85317 - DNA, 17 bp, Homo sapiens
cagcttcttcactgctg

SEQ ID NO: 85318 - DNA, 25 bp, Homo sapiens
gctttgatttcctactctgatttta

SEQ ID NO: 85319 - DNA, 18 bp, Homo sapiens
ccctacagaggatgtcag

SEQ ID NO: 85320 - DNA, 18 bp, Homo sapiens
ccctacagaggatgtcaa

SEQ ID NO: 85321 - DNA, 18 bp, Homo sapiens
cagagcctcccttgtcac

SEQ ID NO: 85322 - DNA, 20 bp, Homo sapiens
tgaatgagcatccaaaagaa

SEQ ID NO: 85323 - DNA, 20 bp, Homo sapiens
tgaatgagcatccaaaagac

SEQ ID NO: 85324 - DNA, 18 bp, Homo sapiens
gcagcacgaagcattcat

SEQ ID NO: 85325 - DNA, 16 bp, Homo sapiens
ccaccagtggctatca

SEQ ID NO: 85326 - DNA, 16 bp, Homo sapiens
ccaccagtggctatcg

SEQ ID NO: 85327 - DNA, 18 bp, Homo sapiens
ggcaagcaggcttgagaa

SEQ ID NO: 85328 - DNA, 23 bp, Homo sapiens
atttaagcatcatagcataccac

SEQ ID NO: 85329 - DNA, 23 bp, Homo sapiens
atttaagcatcatagcataccat

SEQ ID NO: 85330 - DNA, 25 bp, Homo sapiens
tggtacaccataaatcttgacttac

SEQ ID NO: 85331 - DNA, 20 bp, Homo sapiens
tgcaagaggactaagcatga

SEQ ID NO: 85332 - DNA, 19 bp, Homo sapiens
gcaagaggactaagcatgg

SEQ ID NO: 85333 - DNA, 15 bp, Homo sapiens
gcggccttgcactca

SEQ ID NO: 85334 - DNA, 17 bp, Homo sapiens
gcccccctctctgaaga

SEQ ID NO: 85335 - DNA, 16 bp, Homo sapiens
cccccctctctgaagg

SEQ ID NO: 85336 - DNA, 22 bp, Homo sapiens
ccagttcgtggtatgttcatct

SEQ ID NO: 85337 - DNA, 14 bp, Homo sapiens
gccaatgtggcgga

SEQ ID NO: 85338 - DNA, 14 bp, Homo sapiens
gccaatgtggcggg

SEQ ID NO: 85339 - DNA, 17 bp, Homo sapiens
cctggacgacggtttca

SEQ ID NO: 85340 - DNA, 15 bp, Homo sapiens
tgggctccatcccac

SEQ ID NO: 85341 - DNA, 15 bp, Homo sapiens
tgggctccatcccat

SEQ ID NO: 85342 - DNA, 24 bp, Homo sapiens
ccaattctttttcttctttcagtt

SEQ ID NO: 85343 - DNA, 20 bp, Homo sapiens
ctctaacatcaccgtgtacg

SEQ ID NO: 85344 - DNA, 21 bp, Homo sapiens
cctctaacatcaccgtgtaca

SEQ ID NO: 85345 - DNA, 20 bp, Homo sapiens
gagctctgggtcagaactgt

SEQ ID NO: 85346 - DNA, 22 bp, Homo sapiens
ggtaccatggactgtactcact

SEQ ID NO: 85347 - DNA, 21 bp, Homo sapiens
gtaccatggactgtactcacc

SEQ ID NO: 85348 - DNA, 20 bp, Homo sapiens
aggttggttctggagatgac

SEQ ID NO: 85349 - DNA, 20 bp, Homo sapiens
caaatacatctcccaggatc

SEQ ID NO: 85350 - DNA, 20 bp, Homo sapiens
caaatacatctcccaggatt

SEQ ID NO: 85351 - DNA, 25 bp, Homo sapiens
gttttaattgcagtttgaatgatat

SEQ ID NO: 85352 - DNA, 16 bp, Homo sapiens
ccggcttgcacttcac

SEQ ID NO: 85353 - DNA, 16 bp, Homo sapiens
ccggcttgcacttcat

SEQ ID NO: 85354 - DNA, 18 bp, Homo sapiens
ctttgtggccgcagtagt

SEQ ID NO: 85355 - DNA, 21 bp, Homo sapiens
ggcaactcctagtagtacaac

SEQ ID NO: 85356 - DNA, 21 bp, Homo sapiens
ggcaactcctagtagtacaat

SEQ ID NO: 85357 - DNA, 22 bp, Homo sapiens
ggaagtttccatccaaatttac

SEQ ID NO: 85358 - DNA, 21 bp, Homo sapiens
atatattgaccgttctcccat

SEQ ID NO: 85359 - DNA, 21 bp, Homo sapiens
atatattgaccgttctcccac

SEQ ID NO: 85360 - DNA, 18 bp, Homo sapiens
gccacctccaaccatatc

SEQ ID NO: 85361 - DNA, 22 bp, Homo sapiens
ccctgtactttcataagatgct

SEQ ID NO: 85362 - DNA, 21 bp, Homo sapiens
cctgtactttcataagatgcc

SEQ ID NO: 85363 - DNA, 17 bp, Homo sapiens
acgacgccaaggtgata

SEQ ID NO: 85364 - DNA, 17 bp, Homo sapiens
cacaatcaccacggtct

SEQ ID NO: 85365 - DNA, 16 bp, Homo sapiens
acaatcaccacggtcc

SEQ ID NO: 85366 - DNA, 20 bp, Homo sapiens
ccttctgcatcagcatcttc

SEQ ID NO: 85367 - DNA, 16 bp, Homo sapiens
gggtcggtgcaagagg

SEQ ID NO: 85368 - DNA, 16 bp, Homo sapiens
gggtcggtgcaagaga

SEQ ID NO: 85369 - DNA, 18 bp, Homo sapiens
gcaccttggtgggtttgt

SEQ ID NO: 85370 - DNA, 17 bp, Homo sapiens
ggacgtggacatggagt

SEQ ID NO: 85371 - DNA, 17 bp, Homo sapiens
ggacgtggacatggaga

SEQ ID NO: 85372 - DNA, 15 bp, Homo sapiens
cggcgctcgtaggtg

SEQ ID NO: 85373 - DNA, 14 bp, Homo sapiens
cggccctcaggacc

SEQ ID NO: 85374 - DNA, 15 bp, Homo sapiens
ccggccctcaggact

SEQ ID NO: 85375 - DNA, 19 bp, Homo sapiens
gcggaaggtaccaagtttg

SEQ ID NO: 85376 - DNA, 18 bp, Homo sapiens
ctgttgtcctgcttccaa

SEQ ID NO: 85377 - DNA, 18 bp, Homo sapiens
ctgttgtcctgcttccag

SEQ ID NO: 85378 - DNA, 22 bp, Homo sapiens
gtttctgcatcagtgagatttt

SEQ ID NO: 85379 - DNA, 23 bp, Homo sapiens
atttaacaccactatactctcag

SEQ ID NO: 85380 - DNA, 23 bp, Homo sapiens
atttaacaccactatactctcaa

SEQ ID NO: 85381 - DNA, 22 bp, Homo sapiens
ggatatgccttctttggaaata

SEQ ID NO: 85382 - DNA, 24 bp, Homo sapiens
aatataccattctgttaggactta

SEQ ID NO: 85383 - DNA, 23 bp, Homo sapiens
atataccattctgttaggacttg

SEQ ID NO: 85384 - DNA, 19 bp, Homo sapiens
gtggtggtgggtcagtatg

SEQ ID NO: 85385 - DNA, 15 bp, Homo sapiens
ccagcagtatggacg

SEQ ID NO: 85386 - DNA, 17 bp, Homo sapiens
tgccagcagtatggaca

SEQ ID NO: 85387 - DNA, 18 bp, Homo sapiens
ccatccagcctcaggaac

SEQ ID NO: 85388 - DNA, 21 bp, Homo sapiens
cacaccagcaatgatgaaact

SEQ ID NO: 85389 - DNA, 19 bp, Homo sapiens
caccagcaatgatgaaacc

SEQ ID NO: 85390 - DNA, 21 bp, Homo sapiens
gggctaactctttgcatgttc

SEQ ID NO: 85391 - DNA, 16 bp, Homo sapiens
caccctggctggagag

SEQ ID NO: 85392 - DNA, 16 bp, Homo sapiens
caccctggctggagaa

SEQ ID NO: 85393 - DNA, 19 bp, Homo sapiens
ctccctgtcccaaaaagac

SEQ ID NO: 85394 - DNA, 16 bp, Homo sapiens
tggaggctgatgggta

SEQ ID NO: 85395 - DNA, 15 bp, Homo sapiens
ggaggctgatgggtg

SEQ ID NO: 85396 - DNA, 18 bp, Homo sapiens
cgctttgcagccataact

SEQ ID NO: 85397 - DNA, 17 bp, Homo sapiens
caccctgcagatggaac

SEQ ID NO: 85398 - DNA, 17 bp, Homo sapiens
caccctgcagatggaag

SEQ ID NO: 85399 - DNA, 24 bp, Homo sapiens
caagactccttcatcctcaatagt

SEQ ID NO: 85400 - DNA, 15 bp, Homo sapiens
cccacagcctgcgat

SEQ ID NO: 85401 - DNA, 15 bp, Homo sapiens
cccacagcctgcgac

SEQ ID NO: 85402 - DNA, 18 bp, Homo sapiens
ccgcttgaggtccacata

SEQ ID NO: 85403 - DNA, 17 bp, Homo sapiens
cattgctggtttccacg

SEQ ID NO: 85404 - DNA, 17 bp, Homo sapiens
cattgctggtttccaca

SEQ ID NO: 85405 - DNA, 18 bp, Homo sapiens
ggcagtggcacacaatct

SEQ ID NO: 85406 - DNA, 24 bp, Homo sapiens
aggttgtacctgtagcactaagac

SEQ ID NO: 85407 - DNA, 25 bp, Homo sapiens
taggttgtacctgtagcactaagat

SEQ ID NO: 85408 - DNA, 21 bp, Homo sapiens
tgggctcctcagagaaaatat

SEQ ID NO: 85409 - DNA, 21 bp, Homo sapiens
aagataagcctgtcactggtc

SEQ ID NO: 85410 - DNA, 21 bp, Homo sapiens
aagataagcctgtcactggtt

SEQ ID NO: 85411 - DNA, 22 bp, Homo sapiens
caagccagcctaataaacataa

SEQ ID NO: 85412 - DNA, 21 bp, Homo sapiens
cagaaggaagactaccattat

SEQ ID NO: 85413 - DNA, 21 bp, Homo sapiens
cagaaggaagactaccattac

SEQ ID NO: 85414 - DNA, 23 bp, Homo sapiens
cctccccctatttatttttacat

SEQ ID NO: 85415 - DNA, 18 bp, Homo sapiens
ggccactttgcctgaata

SEQ ID NO: 85416 - DNA, 18 bp, Homo sapiens
ggccactttgcctgaatt

SEQ ID NO: 85417 - DNA, 25 bp, Homo sapiens
cgaaatgttcatttttaaagtcaga

SEQ ID NO: 85418 - DNA, 17 bp, Homo sapiens
gatgcccagattcctaa

SEQ ID NO: 85419 - DNA, 17 bp, Homo sapiens
gatgcccagattcctag

SEQ ID NO: 85420 - DNA, 18 bp, Homo sapiens
gctccatgccttgattct

SEQ ID NO: 85421 - DNA, 18 bp, Homo sapiens
gcccagagacaggaaaat

SEQ ID NO: 85422 - DNA, 18 bp, Homo sapiens
gcccagagacaggaaaac

SEQ ID NO: 85423 - DNA, 16 bp, Homo sapiens
gcctgccctctgttca

SEQ ID NO: 85424 - DNA, 16 bp, Homo sapiens
cagacctgcagcttca

SEQ ID NO: 85425 - DNA, 15 bp, Homo sapiens
agacctgcagcttcg

SEQ ID NO: 85426 - DNA, 24 bp, Homo sapiens
tgtaacccatcaactctgtttatc

SEQ ID NO: 85427 - DNA, 14 bp, Homo sapiens
cgctgcagggtcat

SEQ ID NO: 85428 - DNA, 14 bp, Homo sapiens
cgctgcagggtcac

SEQ ID NO: 85429 - DNA, 18 bp, Homo sapiens
cctccccgcagagaatta

SEQ ID NO: 85430 - DNA, 21 bp, Homo sapiens
ccaatagtcgttttttgttgg

SEQ ID NO: 85431 - DNA, 21 bp, Homo sapiens
ccaatagtcgttttttgttgc

SEQ ID NO: 85432 - DNA, 20 bp, Homo sapiens
gctgtgtgggaagtcagaac

SEQ ID NO: 85433 - DNA, 19 bp, Homo sapiens
cttattttcagcgaaaggc

SEQ ID NO: 85434 - DNA, 20 bp, Homo sapiens
ccttattttcagcgaaagga

SEQ ID NO: 85435 - DNA, 18 bp, Homo sapiens
ccaatggtcgtcatctcc

SEQ ID NO: 85436 - DNA, 19 bp, Homo sapiens
gggcagctcacctctctag

SEQ ID NO: 85437 - DNA, 19 bp, Homo sapiens
gggcagctcacctctctac

SEQ ID NO: 85438 - DNA, 21 bp, Homo sapiens
gagtgactgccagaattgtct

SEQ ID NO: 85439 - DNA, 15 bp, Homo sapiens
ctcgcagcggtcagt

SEQ ID NO: 85440 - DNA, 14 bp, Homo sapiens
tcgcagcggtcagc

SEQ ID NO: 85441 - DNA, 16 bp, Homo sapiens
gctggcgggaatttct

SEQ ID NO: 85442 - DNA, 15 bp, Homo sapiens
tggcactcagggcat

SEQ ID NO: 85443 - DNA, 15 bp, Homo sapiens
tggcactcagggcac

SEQ ID NO: 85444 - DNA, 22 bp, Homo sapiens
ccaaagaggactgacaactgta

SEQ ID NO: 85445 - DNA, 22 bp, Homo sapiens
gctttatcagagactctgaagc

SEQ ID NO: 85446 - DNA, 22 bp, Homo sapiens
gctttatcagagactctgaagg

SEQ ID NO: 85447 - DNA, 17 bp, Homo sapiens
ccaaggccacggatatc

SEQ ID NO: 85448 - DNA, 14 bp, Homo sapiens
ggccttggtctcgc

SEQ ID NO: 85449 - DNA, 15 bp, Homo sapiens
tggccttggtctcgt

SEQ ID NO: 85450 - DNA, 22 bp, Homo sapiens
tgcagatcagcttgaagaacta

SEQ ID NO: 85451 - DNA, 21 bp, Homo sapiens
gaatctcatgttcaggaaatg

SEQ ID NO: 85452 - DNA, 22 bp, Homo sapiens
cgaatctcatgttcaggaaata

SEQ ID NO: 85453 - DNA, 17 bp, Homo sapiens
gccatggcccataaaac

SEQ ID NO: 85454 - DNA, 16 bp, Homo sapiens
ggatccgaccgttgag

SEQ ID NO: 85455 - DNA, 16 bp, Homo sapiens
ggatccgaccgttgaa

SEQ ID NO: 85456 - DNA, 25 bp, Homo sapiens
tcattttgaactcattttttctaga

SEQ ID NO: 85457 - DNA, 23 bp, Homo sapiens
atgtcctgaaatacacgtatgac

SEQ ID NO: 85458 - DNA, 23 bp, Homo sapiens
atgtcctgaaatacacgtatgag

SEQ ID NO: 85459 - DNA, 21 bp, Homo sapiens
tcccaacgtcaatttcatatt

SEQ ID NO: 85460 - DNA, 16 bp, Homo sapiens
gcttccctgggcttct

SEQ ID NO: 85461 - DNA, 15 bp, Homo sapiens
cttccctgggcttcc

SEQ ID NO: 85462 - DNA, 22 bp, Homo sapiens
tgctcatcatgagtttgaaact

SEQ ID NO: 85463 - DNA, 24 bp, Homo sapiens
agataatcataagctggagaacac

SEQ ID NO: 85464 - DNA, 24 bp, Homo sapiens
agataatcataagctggagaacat

SEQ ID NO: 85465 - DNA, 25 bp, Homo sapiens
tgattatgcatcttctgtcttgtag

SEQ ID NO: 85466 - DNA, 16 bp, Homo sapiens
cattggggccaatgac

SEQ ID NO: 85467 - DNA, 15 bp, Homo sapiens
attggggccaatgag

SEQ ID NO: 85468 - DNA, 22 bp, Homo sapiens
atgcatttcatgtgaaaactct

SEQ ID NO: 85469 - DNA, 16 bp, Homo sapiens
gcagccagtttctccc

SEQ ID NO: 85470 - DNA, 17 bp, Homo sapiens
tgcagccagtttctcct

SEQ ID NO: 85471 - DNA, 21 bp, Homo sapiens
catgaaatgcttccaggtatt

SEQ ID NO: 85472 - DNA, 20 bp, Homo sapiens
gttccaaccagaagagaatg

SEQ ID NO: 85473 - DNA, 21 bp, Homo sapiens
ggttccaaccagaagagaata

SEQ ID NO: 85474 - DNA, 18 bp, Homo sapiens
cttgcccccaacagttag

SEQ ID NO: 85475 - DNA, 18 bp, Homo sapiens
tccgttgttctcagggat

SEQ ID NO: 85476 - DNA, 18 bp, Homo sapiens
tccgttgttctcagggac

SEQ ID NO: 85477 - DNA, 18 bp, Homo sapiens
ggttcctggaggcatgtc

SEQ ID NO: 85478 - DNA, 22 bp, Homo sapiens
ccagcaaactatgatgaataat

SEQ ID NO: 85479 - DNA, 22 bp, Homo sapiens
ccagcaaactatgatgaataac

SEQ ID NO: 85480 - DNA, 22 bp, Homo sapiens
tgggatgactctagccacttac

SEQ ID NO: 85481 - DNA, 17 bp, Homo sapiens
cagctggacgacgaaca

SEQ ID NO: 85482 - DNA, 16 bp, Homo sapiens
agctggacgacgaacg

SEQ ID NO: 85483 - DNA, 17 bp, Homo sapiens
cggctctccttgatgag

SEQ ID NO: 85484 - DNA, 18 bp, Homo sapiens
ttggaccctcacatgaaa

SEQ ID NO: 85485 - DNA, 18 bp, Homo sapiens
ttggaccctcacatgaag

SEQ ID NO: 85486 - DNA, 23 bp, Homo sapiens
gccattttccacaataaatattt

SEQ ID NO: 85487 - DNA, 16 bp, Homo sapiens
ccctgtgattggccat

SEQ ID NO: 85488 - DNA, 16 bp, Homo sapiens
ccctgtgattggccac

SEQ ID NO: 85489 - DNA, 17 bp, Homo sapiens
cctgctcgctctgtcac

SEQ ID NO: 85490 - DNA, 22 bp, Homo sapiens
agaattgtgtccaaagaagttg

SEQ ID NO: 85491 - DNA, 23 bp, Homo sapiens
aagaattgtgtccaaagaagttt

SEQ ID NO: 85492 - DNA, 27 bp, Homo sapiens
aactggtataatttgaatcacataaat

SEQ ID NO: 85493 - DNA, 16 bp, Homo sapiens
cagttggttttgtggt

SEQ ID NO: 85494 - DNA, 15 bp, Homo sapiens
agttggttttgtggc

SEQ ID NO: 85495 - DNA, 18 bp, Homo sapiens
tgcttcgtggaggtcaat

SEQ ID NO: 85496 - DNA, 19 bp, Homo sapiens
ccgtctggtaattgtccac

SEQ ID NO: 85497 - DNA, 19 bp, Homo sapiens
ccgtctggtaattgtccag

SEQ ID NO: 85498 - DNA, 18 bp, Homo sapiens
tcaagcccttggctaaga

SEQ ID NO: 85499 - DNA, 30 bp, Homo sapiens
cccggctgggcgcggacatggaggacgttc

SEQ ID NO: 85500 - DNA, 30 bp, Homo sapiens
cccggctgggcgcggacatggaggacgttt

SEQ ID NO: 85501 - DNA, 15 bp, Homo sapiens
cagcttgcgcaggtg

SEQ ID NO: 85502 - DNA, 20 bp, Homo sapiens
actttgcttcccgaagatac

SEQ ID NO: 85503 - DNA, 20 bp, Homo sapiens
actttgcttcccgaagatag

SEQ ID NO: 85504 - DNA, 18 bp, Homo sapiens
tcaccgctccacagactt

SEQ ID NO: 85505 - DNA, 18 bp, Homo sapiens
ctggaaatggttatgggc

SEQ ID NO: 85506 - DNA, 20 bp, Homo sapiens
tactggaaatggttatggga

SEQ ID NO: 85507 - DNA, 24 bp, Homo sapiens
tttataggcgtgaaactaattctc

SEQ ID NO: 85508 - DNA, 25 bp, Homo sapiens
ccttcaattctgaaaagtagctaat

SEQ ID NO: 85509 - DNA, 25 bp, Homo sapiens
ccttcaattctgaaaagtagctaag

SEQ ID NO: 85510 - DNA, 22 bp, Homo sapiens
tttgaggttgagtgacatgttc

SEQ ID NO: 85511 - DNA, 20 bp, Homo sapiens
ctgcattatttctatgacgc

SEQ ID NO: 85512 - DNA, 22 bp, Homo sapiens
ttctgcattatttctatgacgt

SEQ ID NO: 85513 - DNA, 22 bp, Homo sapiens
caaaaaatgccaacagtttaga

SEQ ID NO: 85514 - DNA, 20 bp, Homo sapiens
gttctcccctttcagtgtct

SEQ ID NO: 85515 - DNA, 18 bp, Homo sapiens
tctcccctttcagtgtcc

SEQ ID NO: 85516 - DNA, 21 bp, Homo sapiens
tgtcggtgactgttctgttaa

SEQ ID NO: 85517 - DNA, 21 bp, Homo sapiens
gtggctcattaccaatctctt

SEQ ID NO: 85518 - DNA, 21 bp, Homo sapiens
gtggctcattaccaatctctc

SEQ ID NO: 85519 - DNA, 18 bp, Homo sapiens
gggctccatcaacatcac

SEQ ID NO: 85520 - DNA, 18 bp, Homo sapiens
tcgcaactcacatcactg

SEQ ID NO: 85521 - DNA, 19 bp, Homo sapiens
gtcgcaactcacatcacta

SEQ ID NO: 85522 - DNA, 20 bp, Homo sapiens
agttcttggaggcatctcat

SEQ ID NO: 85523 - DNA, 17 bp, Homo sapiens
ccatgcaaccaaaccat

SEQ ID NO: 85524 - DNA, 17 bp, Homo sapiens
ccatgcaaccaaaccac

SEQ ID NO: 85525 - DNA, 21 bp, Homo sapiens
cctctcatccctctcatcttt

SEQ ID NO: 85526 - DNA, 15 bp, Homo sapiens
gagcctgggccaaat

SEQ ID NO: 85527 - DNA, 15 bp, Homo sapiens
gagcctgggccaaac

SEQ ID NO: 85528 - DNA, 23 bp, Homo sapiens
cctaagaggctggaaagatagag

SEQ ID NO: 85529 - DNA, 18 bp, Homo sapiens
aatggccttggacttgat

SEQ ID NO: 85530 - DNA, 18 bp, Homo sapiens
aatggccttggacttgac

SEQ ID NO: 85531 - DNA, 18 bp, Homo sapiens
ctctgccatgcaaaacac

SEQ ID NO: 85532 - DNA, 15 bp, Homo sapiens
gcgaggacgaagggg

SEQ ID NO: 85533 - DNA, 15 bp, Homo sapiens
gcgaggacgaagggc

SEQ ID NO: 85534 - DNA, 21 bp, Homo sapiens
ggaggatgaatggacagacaa

SEQ ID NO: 85535 - DNA, 17 bp, Homo sapiens
ccgacccgaactaaagg

SEQ ID NO: 85536 - DNA, 17 bp, Homo sapiens
ccgacccgaactaaagc

SEQ ID NO: 85537 - DNA, 15 bp, Homo sapiens
cgcgttccccatgtc

SEQ ID NO: 85538 - DNA, 16 bp, Homo sapiens
accatggtcaccctgg

SEQ ID NO: 85539 - DNA, 17 bp, Homo sapiens
caccatggtcaccctga

SEQ ID NO: 85540 - DNA, 21 bp, Homo sapiens
ggactgaaagcaatgtgagag

SEQ ID NO: 85541 - DNA, 20 bp, Homo sapiens
gccctcagtgtgactgagat

SEQ ID NO: 85542 - DNA, 20 bp, Homo sapiens
gccctcagtgtgactgagac

SEQ ID NO: 85543 - DNA, 19 bp, Homo sapiens
ccaggcatttcccatacag

SEQ ID NO: 85544 - DNA, 20 bp, Homo sapiens
gcataaagccaaggtagaaa

SEQ ID NO: 85545 - DNA, 20 bp, Homo sapiens
gcataaagccaaggtagaag

SEQ ID NO: 85546 - DNA, 20 bp, Homo sapiens
ccactggaacactcacacat

SEQ ID NO: 85547 - DNA, 17 bp, Homo sapiens
cgtcaatgccctcatct

SEQ ID NO: 85548 - DNA, 16 bp, Homo sapiens
gtcaatgccctcatcg

SEQ ID NO: 85549 - DNA, 22 bp, Homo sapiens
gagactgcgatgtctgaatagt

SEQ ID NO: 85550 - DNA, 20 bp, Homo sapiens
gggtcatggtactcaatgaa

SEQ ID NO: 85551 - DNA, 20 bp, Homo sapiens
gggtcatggtactcaatgag

SEQ ID NO: 85552 - DNA, 25 bp, Homo sapiens
tgtacaaaaatgttgtcacatacag

SEQ ID NO: 85553 - DNA, 16 bp, Homo sapiens
ggagcaggatggtgat

SEQ ID NO: 85554 - DNA, 16 bp, Homo sapiens
ggagcaggatggtgac

SEQ ID NO: 85555 - DNA, 24 bp, Homo sapiens
ggaaatatctcgttcttgttctct

SEQ ID NO: 85556 - DNA, 17 bp, Homo sapiens
ggcttacctggcccagt

SEQ ID NO: 85557 - DNA, 16 bp, Homo sapiens
gcttacctggcccagc

SEQ ID NO: 85558 - DNA, 19 bp, Homo sapiens
ccttcagcctccaacatga

SEQ ID NO: 85559 - DNA, 14 bp, Homo sapiens
cggatctctcgcaa

SEQ ID NO: 85560 - DNA, 14 bp, Homo sapiens
cggatctctcgcac

SEQ ID NO: 85561 - DNA, 16 bp, Homo sapiens
tggaggaggtgattca

SEQ ID NO: 85562 - DNA, 22 bp, Homo sapiens
gcagtcctgaacaaagtagatg

SEQ ID NO: 85563 - DNA, 23 bp, Homo sapiens
cgcagtcctgaacaaagtagata

SEQ ID NO: 85564 - DNA, 22 bp, Homo sapiens
cgtgcatgttttgaaaaatgta

SEQ ID NO: 85565 - DNA, 18 bp, Homo sapiens
tacctgagccagttgcac

SEQ ID NO: 85566 - DNA, 18 bp, Homo sapiens
tacctgagccagttgcat

SEQ ID NO: 85567 - DNA, 20 bp, Homo sapiens
ggcttcagctgaagaaagag

SEQ ID NO: 85568 - DNA, 19 bp, Homo sapiens
aaggaggtctgcctaagga

SEQ ID NO: 85569 - DNA, 19 bp, Homo sapiens
aaggaggtctgcctaaggt

SEQ ID NO: 85570 - DNA, 24 bp, Homo sapiens
tacctgcctttaaagaacattact

SEQ ID NO: 85571 - DNA, 15 bp, Homo sapiens
cccgagcggacagtg

SEQ ID NO: 85572 - DNA, 15 bp, Homo sapiens
cccgagcggacagtc

SEQ ID NO: 85573 - DNA, 20 bp, Homo sapiens
caactgctggcagaatcttc

SEQ ID NO: 85574 - DNA, 21 bp, Homo sapiens
cacaccagcaatgatgaaact

SEQ ID NO: 85575 - DNA, 19 bp, Homo sapiens
caccagcaatgatgaaacc

SEQ ID NO: 85576 - DNA, 16 bp, Homo sapiens
ggcgggttccagacaa

SEQ ID NO: 85577 - DNA, 20 bp, Homo sapiens
gctcaggactatctgcagtg

SEQ ID NO: 85578 - DNA, 21 bp, Homo sapiens
ggctcaggactatctgcagta

SEQ ID NO: 85579 - DNA, 21 bp, Homo sapiens
tccaagcatgacttcagattc

SEQ ID NO: 85580 - DNA, 17 bp, Homo sapiens
gccccaacaccagagaa

SEQ ID NO: 85581 - DNA, 17 bp, Homo sapiens
gccccaacaccagagac

SEQ ID NO: 85582 - DNA, 18 bp, Homo sapiens
ccaccaccactcaccaga

SEQ ID NO: 85583 - DNA, 16 bp, Homo sapiens
ggctgaaccccgtcct

SEQ ID NO: 85584 - DNA, 15 bp, Homo sapiens
gctgaaccccgtccc

SEQ ID NO: 85585 - DNA, 20 bp, Homo sapiens
ctttttcctgcatcctgtct

SEQ ID NO: 85586 - DNA, 19 bp, Homo sapiens
tcccatgcttaaggaaatg

SEQ ID NO: 85587 - DNA, 21 bp, Homo sapiens
gatcccatgcttaaggaaata

SEQ ID NO: 85588 - DNA, 27 bp, Homo sapiens
tgagtgtacaattctaattctcagact

SEQ ID NO: 85589 - DNA, 17 bp, Homo sapiens
ccaaagggtgtcaaggc

SEQ ID NO: 85590 - DNA, 18 bp, Homo sapiens
tccaaagggtgtcaaggt

SEQ ID NO: 85591 - DNA, 21 bp, Homo sapiens
gctgctggaatatgtttgaga

SEQ ID NO: 85592 - DNA, 20 bp, Homo sapiens
cacagtcaaagaatcaagcg

SEQ ID NO: 85593 - DNA, 21 bp, Homo sapiens
tcacagtcaaagaatcaagca

SEQ ID NO: 85594 - DNA, 24 bp, Homo sapiens
aaattcttaccctgagttcagttc

SEQ ID NO: 85595 - DNA, 17 bp, Homo sapiens
gagcgctctttcttgac

SEQ ID NO: 85596 - DNA, 17 bp, Homo sapiens
gagcgctctttcttgat

SEQ ID NO: 85597 - DNA, 16 bp, Homo sapiens
gcggaggccctctgta

SEQ ID NO: 85598 - DNA, 15 bp, Homo sapiens
gagcgagggctcagg

SEQ ID NO: 85599 - DNA, 15 bp, Homo sapiens
gagcgagggctcagc

SEQ ID NO: 85600 - DNA, 20 bp, Homo sapiens
cctccctggagaatactgtg

SEQ ID NO: 85601 - DNA, 20 bp, Homo sapiens
tgcgagtcaaatctcaagac

SEQ ID NO: 85602 - DNA, 20 bp, Homo sapiens
tgcgagtcaaatctcaagaa

SEQ ID NO: 85603 - DNA, 18 bp, Homo sapiens
cctattcccggcacttct

SEQ ID NO: 85604 - DNA, 17 bp, Homo sapiens
accagctccagggtgtt

SEQ ID NO: 85605 - DNA, 17 bp, Homo sapiens
accagctccagggtgtc

SEQ ID NO: 85606 - DNA, 23 bp, Homo sapiens
tgaagttttggaatgagactgat

SEQ ID NO: 85607 - DNA, 21 bp, Homo sapiens
cgtctccaggaaaatcataac

SEQ ID NO: 85608 - DNA, 21 bp, Homo sapiens
cgtctccaggaaaatcataat

SEQ ID NO: 85609 - DNA, 25 bp, Homo sapiens
tgagttattgctacttcagaatcat

SEQ ID NO: 85610 - DNA, 19 bp, Homo sapiens
cagaaagttcatggtttcg

SEQ ID NO: 85611 - DNA, 20 bp, Homo sapiens
gcagaaagttcatggtttca

SEQ ID NO: 85612 - DNA, 17 bp, Homo sapiens
ccggggaggaagagtag

SEQ ID NO: 85613 - DNA, 20 bp, Homo sapiens
ccattcaatgcaatacgtca

SEQ ID NO: 85614 - DNA, 19 bp, Homo sapiens
cattcaatgcaatacgtcg

SEQ ID NO: 85615 - DNA, 20 bp, Homo sapiens
cctctccttccagaaccagt

SEQ ID NO: 85616 - DNA, 21 bp, Homo sapiens
cactggtctcagatgtgatgt

SEQ ID NO: 85617 - DNA, 20 bp, Homo sapiens
actggtctcagatgtgatgc

SEQ ID NO: 85618 - DNA, 17 bp, Homo sapiens
gggctggcagggtatag

SEQ ID NO: 85619 - DNA, 19 bp, Homo sapiens
ttctacaacgtggacatgg

SEQ ID NO: 85620 - DNA, 21 bp, Homo sapiens
acttctacaacgtggacatga

SEQ ID NO: 85621 - DNA, 19 bp, Homo sapiens
gcctgccactcacattaca

SEQ ID NO: 85622 - DNA, 24 bp, Homo sapiens
ttgttaacatatacttactggaga

SEQ ID NO: 85623 - DNA, 23 bp, Homo sapiens
tgttaacatatacttactggagg

SEQ ID NO: 85624 - DNA, 21 bp, Homo sapiens
tgcctcttctttatttatgtc

SEQ ID NO: 85625 - DNA, 16 bp, Homo sapiens
ccacttcgggttcctc

SEQ ID NO: 85626 - DNA, 16 bp, Homo sapiens
ccacttcgggttcctg

SEQ ID NO: 85627 - DNA, 17 bp, Homo sapiens
ccctggcttcaacatga

SEQ ID NO: 85628 - DNA, 17 bp, Homo sapiens
gcaacaggacacctgaa

SEQ ID NO: 85629 - DNA, 17 bp, Homo sapiens
gcaacaggacacctgag

SEQ ID NO: 85630 - DNA, 20 bp, Homo sapiens
gagtgacaggaggctgctta

SEQ ID NO: 85631 - DNA, 18 bp, Homo sapiens
cctctgaggcctgagaaa

SEQ ID NO: 85632 - DNA, 18 bp, Homo sapiens
cctctgaggcctgagaag

SEQ ID NO: 85633 - DNA, 22 bp, Homo sapiens
gtcctgattcctcatttctttc

SEQ ID NO: 85634 - DNA, 15 bp, Homo sapiens
gcgctggtttggagg

SEQ ID NO: 85635 - DNA, 15 bp, Homo sapiens
gcgctggtttggaga

SEQ ID NO: 85636 - DNA, 22 bp, Homo sapiens
tggcacaggcagtattaagtag

SEQ ID NO: 85637 - DNA, 18 bp, Homo sapiens
tggtctgttccctggaca

SEQ ID NO: 85638 - DNA, 17 bp, Homo sapiens
ggtctgttccctggacg

SEQ ID NO: 85639 - DNA, 19 bp, Homo sapiens
tgcggtcacactgactgag

SEQ ID NO: 85640 - DNA, 18 bp, Homo sapiens
cacattcacggtcacctt

SEQ ID NO: 85641 - DNA, 18 bp, Homo sapiens
cacattcacggtcacctc

SEQ ID NO: 85642 - DNA, 16 bp, Homo sapiens
cattgcccgagctcaa

SEQ ID NO: 85643 - DNA, 17 bp, Homo sapiens
gtccttgcaagtatccg

SEQ ID NO: 85644 - DNA, 18 bp, Homo sapiens
ggtccttgcaagtatcca

SEQ ID NO: 85645 - DNA, 22 bp, Homo sapiens
gcactacagctgagtccttttc

SEQ ID NO: 85646 - DNA, 14 bp, Homo sapiens
ggtggtccctttgg

SEQ ID NO: 85647 - DNA, 16 bp, Homo sapiens
acggtggtccctttgt

SEQ ID NO: 85648 - DNA, 16 bp, Homo sapiens
cctcgcaggccttctc

SEQ ID NO: 85649 - DNA, 20 bp, Homo sapiens
tcaagaggacagtgatggtg

SEQ ID NO: 85650 - DNA, 20 bp, Homo sapiens
tcaagaggacagtgatggtc

SEQ ID NO: 85651 - DNA, 24 bp, Homo sapiens
tggttagaatctgtgaaggaacta

SEQ ID NO: 85652 - DNA, 20 bp, Homo sapiens
agagagtgcacagtagatgt

SEQ ID NO: 85653 - DNA, 19 bp, Homo sapiens
gagagtgcacagtagatgc

SEQ ID NO: 85654 - DNA, 23 bp, Homo sapiens
aaacctgagttttaacttggtga

SEQ ID NO: 85655 - DNA, 14 bp, Homo sapiens
ggcactgcccgctt

SEQ ID NO: 85656 - DNA, 14 bp, Homo sapiens
ggcactgcccgctc

SEQ ID NO: 85657 - DNA, 21 bp, Homo sapiens
cgcttcctggagagatacatc

SEQ ID NO: 85658 - DNA, 15 bp, Homo sapiens
cagtgccggacagga

SEQ ID NO: 85659 - DNA, 15 bp, Homo sapiens
cagtgccggacaggg

SEQ ID NO: 85660 - DNA, 15 bp, Homo sapiens
ccgcccggcactaag

SEQ ID NO: 85661 - DNA, 20 bp, Homo sapiens
gctcgtagttgtgtctgcat

SEQ ID NO: 85662 - DNA, 20 bp, Homo sapiens
gctcgtagttgtgtctgcac

SEQ ID NO: 85663 - DNA, 20 bp, Homo sapiens
cgcttcctggagagatacat

SEQ ID NO: 85664 - DNA, 16 bp, Homo sapiens
aggacttccgtgtctt

SEQ ID NO: 85665 - DNA, 16 bp, Homo sapiens
aggacttccgtgtctc

SEQ ID NO: 85666 - DNA, 20 bp, Homo sapiens
acagatgccagcaatacaga

SEQ ID NO: 85667 - DNA, 16 bp, Homo sapiens
gcctatccatcctgcc

SEQ ID NO: 85668 - DNA, 16 bp, Homo sapiens
gcctatccatcctgcg

SEQ ID NO: 85669 - DNA, 23 bp, Homo sapiens
ggtaggagagcactgagaatact

SEQ ID NO: 85670 - DNA, 18 bp, Homo sapiens
cagagcctgcacatcaat

SEQ ID NO: 85671 - DNA, 18 bp, Homo sapiens
cagagcctgcacatcaaa

SEQ ID NO: 85672 - DNA, 21 bp, Homo sapiens
ggcaaggtctctgatctgtaa

SEQ ID NO: 85673 - DNA, 15 bp, Homo sapiens
ccgcagaggtgtggg

SEQ ID NO: 85674 - DNA, 15 bp, Homo sapiens
ccgcagaggtgtggt

SEQ ID NO: 85675 - DNA, 18 bp, Homo sapiens
cattttgcggtggaaatg

SEQ ID NO: 85676 - DNA, 26 bp, Homo sapiens
ttattgacactttccagtaaataatt

SEQ ID NO: 85677 - DNA, 26 bp, Homo sapiens
ttattgacactttccagtaaataatc

SEQ ID NO: 85678 - DNA, 19 bp, Homo sapiens
aggcacaagctgcagataa

SEQ ID NO: 85679 - DNA, 20 bp, Homo sapiens
cgcatccagaacattctatg

SEQ ID NO: 85680 - DNA, 20 bp, Homo sapiens
cgcatccagaacattctatc

SEQ ID NO: 85681 - DNA, 20 bp, Homo sapiens
gcagcttcccatcatacact

SEQ ID NO: 85682 - DNA, 18 bp, Homo sapiens
acacctcgcccagtaatc

SEQ ID NO: 85683 - DNA, 19 bp, Homo sapiens
gacacctcgcccagtaata

SEQ ID NO: 85684 - DNA, 20 bp, Homo sapiens
ccccctctccagattacatt

SEQ ID NO: 85685 - DNA, 18 bp, Homo sapiens
agaaggtgggatccaaac

SEQ ID NO: 85686 - DNA, 18 bp, Homo sapiens
agaaggtgggatccaaat

SEQ ID NO: 85687 - DNA, 20 bp, Homo sapiens
agaaaccatcatgctgaggt

SEQ ID NO: 85688 - DNA, 18 bp, Homo sapiens
gcccagagacaggaaaat

SEQ ID NO: 85689 - DNA, 18 bp, Homo sapiens
gcccagagacaggaaaac

SEQ ID NO: 85690 - DNA, 16 bp, Homo sapiens
gcctgccctctgttca

SEQ ID NO: 85691 - DNA, 14 bp, Homo sapiens
ctgctggccgtcct

SEQ ID NO: 85692 - DNA, 13 bp, Homo sapiens
tgctggccgtcca

SEQ ID NO: 85693 - DNA, 19 bp, Homo sapiens
actcacgcttgctttgact

SEQ ID NO: 85694 - DNA, 20 bp, Homo sapiens
ctcaggaagctaaaaggtga

SEQ ID NO: 85695 - DNA, 19 bp, Homo sapiens
tcaggaagctaaaaggtgc

SEQ ID NO: 85696 - DNA, 23 bp, Homo sapiens
cctaatatcccctccagaactat

SEQ ID NO: 85697 - DNA, 23 bp, Homo sapiens
acatttcagaacctatcttcttc

SEQ ID NO: 85698 - DNA, 23 bp, Homo sapiens
acatttcagaacctatcttcttt

SEQ ID NO: 85699 - DNA, 22 bp, Homo sapiens
agttcatatggaccagacatca

SEQ ID NO: 85700 - DNA, 18 bp, Homo sapiens
gctggtcatcctcatcca

SEQ ID NO: 85701 - DNA, 19 bp, Homo sapiens
tgctggtcatcctcatcct

SEQ ID NO: 85702 - DNA, 19 bp, Homo sapiens
accgtcctggcttttaaag
